United States Patent 7,368,527 (HADDE71 POLYPEPTIDES) - sequence listing, part 5

SEQ ID NO: 8734 - DNA, 6795 bp, Homo sapiens
gcagtaacgctgctccggctgcccggcggccaggaacggaagcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggtgcggcctgggctaaggggagacaagggaggctggtggaccaggcctgggccggtagcgggaaccccgggggcggcccagctgggtcctccgagagccggccgccatcgtgtgctttctcacaggagagaagccgggggatgtttcattcattcggccgaggccatcgagctacagctatgggccaggctcgggctgcaggtgttcgtcctcgtggcccttcctggctggcgaggagaagagctgcctatgggacagagctgcggtcctgagctgcagtagcgcctgggaggcactacagggttggaatccagattactcccttcccagaccacgtctcagggtggctgggggtacaccccagagtggggctgagcattctccattctctctgccaggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctgggctcaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgatatcctcctggcggtccctgctggggggagtgggcaaggggccctctggttcaacttgccctgagtcctgttcctcttgggagtttgtcttatagccactggccatggcccagcctcaggctccctcctcagagcccctccccttccactcttagcctgtgatccctcccccggtggacctgagtccccagaacggtctctgagggcctgtgtgtcagaccttagctaaagaattgggtcttttctgtagtctgccatctgtcaccatagggcatcagccattctccttaaccctcacactttggcctacgtcactcatgaggacatctgcagatgctttgctggtgagcagagcctgggtaggggtaagggggtgggctgggctcagccaaagtcctgagcactgggctcagtgtcttaggagagttctgtctcttaagagggtttctggggcctgctcagagaggaaccaggcagggtaagtcttctgtctgagtgtcactgggaccctgtggaggtcagctataccaaaagggtacagaaattctggagtgggtccctgggtctgttcccatctctactgtttcctggatttggcttcttgggtatgatagaggcacaagggggagagagggagagaggatatgtgtgtatttgcttgtgtgcaggctcttacatgcagggcatgggggtgcccacttccaacttgttagtttagttgcattgtgaatacaggatctgttcctttttttttctttttaagagatgggctcttgctgtgttgcccaggctggtcttgaactcctgagctcaagctgtcttccctcctcaaccccctaaagtgctgggattatgggtgtgagccactgtgccccgctgatgtgtttcttctccatcttgtatgctcctgactggtcatgggaaagggatgttggccttggctagaacaccctcacctagggatcagccatcggtagaggaatgaggtgcctgtggccagtgatctttcactccacataattgaacccagatttcctggttactgaccctgggctctcaggaagagaagagctttagctctgcctggccactatgggggatgggtgaggcccactgtctagttcctcagggaccgtgatctcctgccttgctccaaaaggcaggcacctctgttcccagctcagattgagcccatgggctctgacccattctccatgtcattctaggagataccctcttggccatccgggccccatcaggcaccagcctggaggtgcccatcccagaggtgggtgcttagcccaggcaggcggggtcagctgagggcgggtgctggctgtggagcctgataagtcctgggtggggcaagtagggggaggcctggagtttggggttatctaggaggatgggcatcctgggtgggagaggacactgtggtcctgacccggagtcgggcaggagccaagcctgcttacaattctacccatctcccatcccttaccacccatctctagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacaggtgaggcaccatgggagcttgtgacagaggcccaagaggtagtatctctgtgttgtggaacaccatgctcagagttggaagagactcttcaggttggggattgtccttttcctgaccacctagccttcccttgctatggtaatgaatgagccttttttgtttttgtttttgagacggagtctcactgtgtcccccaggctggagtgtgcaatggcgcgatcttggctcactgcaacctctgcctcccaagctcaagaaattttcctgccttagcctcctgagtagctgggattacaggcgcccaccatgcgcagctaattctcgtacttctaatagagatggggtttcaccatgttggccaggctggtttcgaactcctgacctcaaatgatctgcctgcctcggcctcctgtagtgctgggattacaggcttgaaccaccatgcctgcctgaatgggccctttttaacagggaacctctgactgtgggaagagccattgctggtggcagttttctcccccagatccacatccactggtgtctcaattgccctggtagcccgtcttgaagtatggccacagcagacatgttgaccacgagtcttcttctgtaggtcttgtgtccctgtctcctgtggtgactaatttcaggttacttcctctgggggtgactggcaatgcctaattctccttgggtctgggaaccaggcttgtggtcctcctgtgtctgggttccagcacagccagtttcaacgacctcttcctgaccttgtatgactgggtttgggggctatcattgtagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggtgagtacctgccccctgggggcagagagagagagtctagcctcagtccagtcctaggtcagaaaacagaattggggatggaacccagatctcctgtcaaccctgctggacacgagagctctctgccagcacctctgggtcagtgctggtgccccctctagcaccccatcctaggctaacacagaactccctgccgtctctcaagccctttcctgccaccccttggagcaccgcctcactaattgacacttctctgtatcactctctctcatcttctctgtctcctttctgtctggactccttgaaaaagtaatctccattcattagtctcctagtcacctttcaggttgcagcagtcacccccccagccccagtgttacagcggtgttactcttgagaagctgccgaaggcctgccgagcccagcagcctccagcgtgttttgctggtgctctcttggtctgtgtcaatattctttcctcctttggcatcatgatgccagcttttggctctcctatctcactggcttcttgaactcttccctggcgtgtccttaaacattgctgtttttgagggctctgtcccattccactcctggagagggctgcagctctgggtgaacgaatccccagcctccgcctggcctagatcttttcccaatctgcacacttcggtgtccacctgccgtcctgtgtacatccaatggacactttattcctgcatgtcctcaactgaacttagtttcctcccgaagcttgctttccacctctgcgcacccagccgtcagccctagttatccaggcctgacccttggctctcactctagttctagttccttatccctcctccttctgctgcccaccccatgccagctaactgaggtctgtcccagatgtcccctcctatcctctggtatcctcagcactcaggatgacccctggccacctctgtcctggattcttcagcatctttctctttaccctgactgacagactaatctttctgaaatgcaggcctgacagaaaaatgtggcatttctctgtttgcaaaagtacctttaatggctccttgagggccaccagataagatctgaactcctgagcctggcatgtgaaatccctcatagtcctctctggttgcattttcttctgcttcccctgtgtcctcctggccagaggtttgtagtggagtcatcaccctgtagcgccaccacctctgcctggtgacctgacccagggtctggtctcagtcttgcacagagcaggtgctcagcaagggtgggacagatggggtaccttctgtcagacagggggtgcatgctgagcccagaaagaggcttctgtggcctttccgagttagaaaagctgtaccaatcgcttgcagggggcctttggtaccctgggctcagcactgaggaattcaggtttagcaagtgaggccaacagacagtgccagcttggcctaggcaggacctacatctccttagctgtgtggagcctcagggtgggtggtataggatccgaggaagccagggggctgtagtggggccaggctggacctctgtgccctgagcatggctttcttgtttttcagttttggaactccccaaagagctgtcagaaatctttgatcccacacgaggtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 8735 - DNA, 9507 bp, Homo sapiens; identical to SEQ ID NO: 6413

SEQ ID NO: 8736 - DNA, 434 bp, Homo sapiens; identical to SEQ ID NO: 6414

SEQ ID NO: 8737 - DNA, 464 bp, Homo sapiens
gcaggtttaatcatgcctctccctgcctaaaaccttcccctggctcctattctggaagagtgtcgtagggcagcatgtaaaacgccacgcatgccccgcccagcctgccttttaatcttcatctctggccacactcttctagcactgcctgtctgcccagctcccgcccatgcccccccgccccgcgcagccttctgtcctgtaaccaccttccccacaatatgccatcattccccctgttaatggctctgcccttgcccactgtcctatcctggaatgactttccctcatccttctttcttctaatgacctcctattcatccctcaaaacccagtgcaaaggatcccatgatctcctgccttcaggcaaaatgactcaccttcctcctcaggccaccccagctcccactattggcgatcccatcatcctttgctaacacaccacctcctggatcacctgggct

SEQ ID NO: 8738 - DNA, 460 bp, Homo sapiens
ggttgggtgtgagggagctaacagttggccccttgctctgttctcagattcttgaggtttatttcccccttgaattgtcccaacagtcctgtgaggtggatgtcatttattacttctgcacagatgactaaacaatctcaggggagcctggtcattaattggccatgatcaaaaaggtagtgaaagcacatggcagcactttgggaggccgaggcgagcggatcacttgaggccaggagtttgagaccagcctggccaacatagtgaaaatccttctctactacaagtagaaaaaattagccgggcgtggtaatgcatggccgtaatcccagctactcgggaggctgaggcacgagaatcacttgaaccaacccaggaggcagaggttgcaatgagccgagatcgcgccactgcactctagcctgggtgacagggcgagagactctatctcaaaaaaaaa

SEQ ID NO: 8739 - DNA, 1266 bp, Homo sapiens
gattctttaacaaaatagggacaatgacaaggttactggtagcccttttattctcctcatttttaaagctgagagaggtggaatccattagtaagataaaaaacaaaatgtcaaaaagacaagacttaagaacaggttgggcatgctccaacatgacagcatgcacactttggggaaaaatttattggtctagccaggtgtgagcctccattccttaatgtgccagctggactccccttaccaaatcttggccccaagagtttgtttccagtcagtgggctttgctatactgacagacatgttccatacaggagcttctgatgggcaaacagtgggtgatacagtcacactcactaccttctacctcctgtcttctctcaatgccagtgacctaccaccatgctgcccagaaccttcccatcaggcaaataaaaacctgcatatttgtcacacactttgggtctatatagaccattaacaaagtgatgaaaacatctggtgctaaatgacagcatgatgtggcatctcttgcctggcccagccaaggatcagagagttaacaggacttggtaaatagcttctctcatctttctctctctgccctaagcaagtaaaactaaaaaccacaacaataaataaactcataacaccctcagtttcttcctcttttttttttttaccatctgatagatgtcaggacagatgttgtccacaacacacttgccaacaaccatttcagtgcttcctgacatatgtttaagaaagatggctgctgtataacggattttacttaaatgccgataagcaaccttccataacattgttcagcgaagataaaagataatgccacttctgtccattctggtgcccatgtcaacatgatcactaattcaaatttttagggatcaaaaaagtcaacaccaagcttatataaatagcttttaccatctggttgctcaccttgactgtaggaagcagagtcctatcaattcttttctactaggaaaaaggtgtctcatcatagagaggaaggggaggaataataaaagaaaaacaatttgtaatagcatgctatcccttttttcctgttgacaggaaatcaagttctcagcttgttaattaagttaaaaatacagaagtttcctggttattctctcatcagtttcagagtgttcatgactttgaagtaggtctcaccggtgagtgcttaaacattgaactaatgagattttactgttttgaacagctggtcaagtttggaggccc

SEQ ID NO: 8740 - DNA, 853 bp, Homo sapiens
ggacaatttactttgttttgctaagtttacatgtccaatcggtgacagggccagaaagagaatctaggcctgcttcccagcaacagtgtagatgtgaaggtaaggtgaaccacctgtgtcccttgaattgcatgcttatccattgtctataaggcagctttatctggcagtgaaattatgtgtcatttctggtgggtggctgggcctgccatagcaaattaccacaaacagaaatgtattctcttatataattctggaggcaaagtctgaaatcaaagcatcagcagggccatgctctctctgaaggctttagagaagtatccttccttgctgcttcctagtttctggtggttgccagcaatccttggcattcctggacttgcagatgcatcactgcaatctctgccttagtatccacatgaaatttttcctgtgtgtctgtctgtgtccagattgtcttctttttatgggggccattcattggattagggtcttccctaatgcaatatggcctcatcttaatgtgattacatctacaaaaatactgtttcaggccgggcctggtggctgaagcctgtaatcccagcgctttgggaggctgagacgggcggatcacgagatcaagagatcgagaccatcctggtcaacatggtgaaaccccgtctctagtaaacatacaaaaatcagctgggcgtggtggcacatgcctgtagtctcagctacttgggaggctgaggcatgagaatcgcttgaacccgggggcagaggttgcagtgagccgagatcgcaccattgctctctagcctggcgacagagcaagactgcgtctcaaaaaaaaaaaaaaaaaaaaaaa

SEQ ID NO: 8741 - DNA, 216 bp, Homo sapiens
ttttcttcactggtgaaaactattcacgtacctcaaagccttttaatacaatgtagcctgatttcagagtcattatgtggtcatttcaacatatgacggacatgagttaatctagcactaattaaaattaatatgtagttattccaattcaaggtttatggtttatgcgttgctatatataatcctgtgtaattaatgtgtgtgtttcctctatcc

SEQ ID NO: 8742 - DNA, 48037 bp, Homo sapiens
gaggagatccgctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagctggcggcgcccccaataaccacggagccggcagcggcgcgggaggccgtgcgggtaaaggcccgggacgcgggaggaagtccggccgggcgccggagcccacatggcgtaggggtgcggtccgggggcgcgcggccctggggcccggtcggcacgtggggcgctgacagtggcgccgtctgcctgggtggggcgccccgagcccgggagccggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttgggtgggcgtttagagatcccaggagttggggaggacgaatggccgagttttcctttcaccttaggcccagccgagagagcgtcttctgctgcgttttctactattgaaactgtaattacggtttaaactgtccgtggcccccaaccgtcctgaaggaatcccaagatgcattgcagccttgtgatcgggcagaaacttggctatcaataccaagatctgttttacccttagcattgtgtacgcttctaaagtttacaaagtgccacaaagttaggattcctcacttaatgtgtgataggagactatattgatttgtgtctttttaaagtgaagcttacacttttatcctttgtcagcgacacgtttagagaattttcattgctgtaaaatcgttgaccttattcagattgcttggaataactcactgtgttcgtgcatcagtagttcagtctatttcttcagacacttgagcatttgttataatttaatagttctcacgtgtctttctgaccgtagctagtagacatacattttctaatccataaaatttcgagttaactttggtttttaaacatcttcccgtacttaggggttgcttaagtcgtaggtagcatgcttgcaggtgctgacgttgtaggaatatccggtgagtgaacttatgtattctcataatggtgcttattttgtggtaggtagcttgctttcaggtactgattttgtgggaatgtcaaatgagtgaacttaagtattctcttcctaatggtgcttattttaggaactatcagtgtttccttaaagagaaaatgaaaaaggaaggaaaaggctgaacgtcctttcatcatttagccaggacgttagtggggtgggtcatgacatccagcgcattttaagtgagaacatattgttgatttctctctttaaagttctgtattgtggtggttcttagataagtggacattataaaagtgctccaggagtttggtttctacagaaacttttgtcaccgtttgctctttcgtggtaaagggatagtgtctggagaaacactctgatgacgtatgtacgtcagcacggttgatttggtggttttgttgacagtggcatttatttgtgtgggtggttgatgttttcttttgaggagatcgagcactttcagggtggtacggctctagacaatgttttcctcttgaataaggaagcttagcttgtaattcttgacttacatcaagccattttgactgcctaacctagttcacttctcagctcctaaaagtgcccattccctaccttactttgcagattccgtttatccagccattttctttcttggctcttcctcctttctgtggagccaccagcaccactctgactagactcaggactccatttacagcctgtccagcgagtcatccggggataaccaaccttggtctagaatggtcactgttggtgactaggtattacctcttatgcgggctttctctcttcctgatagttgctaatttgtagttacacctaatctttttctctttgacagtgctagaaattggagatgcgaaaacctgtagggaagtagctgtcagtaagagaatccgtacagcatggtcaactttcttgtttttaatcaaaaaactattttggtgttaccgactttaccaattgcttgtaccaaaatgccagttcatgtttttaaaaaattatcctatgtaggatgtctatttggaaaagaactgattttctaagttgaggtccagggttatattgagactgttggattgcatgttccagactattaagtccataaaaagccagcatcggagaacaatcagtgcttataaaaagcagggggataaataggaaataacacctggattggaacttacaaagggggaaccaaaaagtttgcaaggtttttttgatagcgaggaagtggacaatagggctagcatgttctgttctttagttaagccatagccgaaatttgtgctgggtgtgtttttaaactgcatgccgggaaagctgttgaaggagcctggagagtcagaccttgggattcagtattgaccttggatctctttgaaaactaaagaatataggttccttaagaaataattaagtggaacccatttaagtgtaattaagtgtaattcatttaagcacagttctctagagccaagtaaattggccaagagattctccttaaaaagtgaggtccccaagtgaataaaaatatagaagacaaggcttaatgtatattagaacaagcattttatctgataggatgtatttaagttgcaatttgcacctagttttttttattgttagataagaaactggtttagtaattttagggttacttgaactttttagaacagccagagcttctaaagtaatgatgtggtgttctttgcatcatcccacctttaatgcttctcagaactcactgccattaagaaacaagcatggaataaaaccagcagccctcagtacttacttggaggaggcactgtctccaaaacttagcagattgtattgtggaacttgaattttaaagagaaacattctgttttgtagtgttccgtatttgctgaatgccttatttattggaagaggagggtttttttttgttttttttttttttttgagacggagtcttgctctgttgcccaggctggagtgcaatggcacgatctcggctgactacaacctcctcctcccaggttcaagcaattctcctgcctcagcctcccgagtagctgggattacaggcacctgccatcatgcccagctattttgtgtgtgtgtgtttttgcagggatggggtttcaccatgttggctaggctggtcttgaactcttgacctcaggtgatctgcccgccttggcctcccaaagtgccgggattacaggtgtgagccaccgcgcctggccttttttttttttttttttaaatgattgacatttaacttacacactgtaaaattcacccttttcaactgtacaagctgggcgcattggctcacacttataaacccaacactctgggaggctgaggtgagaggattgcctgaggcctccataaaacatagtgagactgagaccctgtctccacaaaaaaaaaaaaaaaaaaaaatacagctgggtgcagtggctcatgcctgtaatcccagcactttgggaggccgaggtggacggatcacctgaggtcaggagttcgagaccagcctggccaacgtggcgaaacctgtctctattaaaaatataaaaattagccaggcatggtggtgcgcgcccgtagtcccagctactggggaggctgaggcaggagaatcacttgaatctgggaggcggaggttgcagtgagccgagatcacaccactgcactctagcctgggcgacattgacactctgtctcaaaaaaaaaaaaaaaaaaaatagctgggtgtggtggcacaaacctgtagtcccagctacttgggaggttgaggtgggaggatctcttgagcccaggagctggaggctgcagtgagctatgatggcaccattgcactcagcctgggtgaccaaatgagacactgtccaaaaagaaaagtaaagtgtacatacagttcagtggcttttaatatatttgtaaggttatgcaaccatcaccacttggcagatgctttttagaatattctcagttttaagctggaacatctcagaagtgacctcttcagggccaccagagtagagaggattccaaatcaaagtaatggttgtttaatccagaaaggcccttacactttattaatatgttaaattctatctgttgaggtagataataggtaagattctgtatttgagaatgtgtttttgagactgaagtgcctgcaagaacagtgctcatataaaggtgtttttaggcttcagtgggacagcagatggggtagaggagaggccccacagtatccctggagtatcacagtagtaaacactgcctttcgttacttctcctgccatggctgacctttttgtctcttgtttcatggttttacacgtatgaatggcttgagactgaggatttagggaagaagcgaaggcatcatctagggctgtgctgtgccaagttgagcagttgtttaaactgttagaatttttgactggtgtaaaaaccctctttggagcaggtattacgtagtgctgtcagtacatatcttattgcattcttctgttctttattttttaccttttctgaagttgcacagcgtgaaaagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttactagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagttgcagccaaagcctgatcaccaaggttgtgtgtattttaaaaaactttttacttattattttttagagacgggatcttactttgtcacccaagctggagtataattgtgtgattatagctcatcgtaacttcaaatccctgggctcaagtgatctttcacctcagcttcctgagtagctaggactataggcacccaccacgacgcctggctaagtttttttgtttgtttttgttttttgagatggagtttcgctctgtcacaggctggagtgcagtggccctaactcggctcaccgtaacctctgcctccccaggttcaagcgattgttctgcctcagcttcccaagtagctgagattacaggtgcccgccaccacgcccagctaatttttgtatttttagtagagatgaggtttcaccatgttgcccaggctggtctcgaactcttgacctcaagtgatccacccgtctcggcctcccaaaatgctgggattacaggcgagagccactgtgcctggccaagttttgtatttttaagtttgtcgagagtgctgaaggtagagcactggttatctttttacagtacttgtctatttcgtattaaacagcagtgagttcagttactatgagtctggctagtgtgtctattggggcatgtttagaatttcatcattctacccttggttttaaaatatcttcgggagacaagaatttggctactagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttttttttttttttttttttttttttttttttgagacggagtctcgctctgtcgcccaggctggagtgcagtggcgggatctcggctcactgcaagctccgcctcccgggttcacgccattctcccgcctcagtctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttgtatttttagtagagacagggtttcaccatgttggccaggatggtcttggtggctactgacctcaagtgagccacccacctcggcctcccaaagtgctgggattacaggtgtgagccaccgcacccggctgtttctgttatttttgtacttttttgagggtatctgaaatggttttggtttgtgtattttaaatgttatttaaatggttttttgtttcttttttgtttttgagatgaatctctctatgtcgcccaggctggagtgcactggcacgatcttggctcactgcaacctctgccttcctggttcaagcgattctcctgcctcagcctcccaggtagctgggattacacgtgtgcaccaccatccccagctaatttttgtatttttagtagagacggggctttgccatgctggccaggctggtctcgcactcctgacctcaagtgatctgcccacttcagcctcccaaagtgctgggattacatgtgtgagccaccgcgcctggcctcaaattgtttttgaagtagttaggttgtagctcataagactgtctttcagggttgtttgaaaaacataatggaattttagttactctatgcaaagtctgatcaggttgataatgtggcattgcttttgtgtccgaataaagaggttcttagaatgttagcgctggatacgaccctagcagttgtacagcctcttcattttcagataaaggaactggagccttagaaatgctaagtaaatgcctaaggtcactcacagagttaatgacaccattgagtctagaatgcagatttgctacctgctagtttagtgcttgatctgccacatcatgctgtttaataacagggggcgggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacgggagaaaaaaagaaaaacctcagcttgcaaatttttgttcagagatgggatcgttctttgttgttggagggatttacattaaaaaaattcaagaaatattgtctcatgtgatcttaccagataagtgcctattattaagacttgttggctgctggatttattatcttagcctaattttctttctgagttaaatgaatcttgcttttttatcgttaccaccctggcataatccaatgggaatatagtatgaaccacatagttaatttaaaattttctttctttaattttgttttttgagacagggtctcacattgttgcccaggctggagttcattggcacaatcatagctcactgtggcctcaacctcctgggcttaagtgattcttctgcctcagcctcctaaatagctgggactacagttgtatgcctccacgcctggctcatttttacatttttttttgtagagacagagcatcactgtgttgccctggctggtcttgaactcttggcctcaagcaaccctcttagcttggcctcccaaagtgctgggtttataggcgggaaccaccacagctggcccaacatctcctgagtgtagtgtttccctaaccccttcttagaaagttggcacatttaaaattgttttcactctcttgagccctaatggaaatgcaatgaatgtacagatggaggctaggggtcctggtcagaaaagggaagtgaggccagttgtggtggctcatgcctgaacccaggaggtggaggttgcagtgagcccagattgtgccactgcactccagcctgggcgacagagtgagactccatttcaaaaagaaaaaagaaaagtgaaaaaatgaagtgatgtgactggaaggaaccagtgtgaaaatcaaaggaaaacacagtaattcagtaaaaattgattgtgtatttattctatacaatacatcatgccaacttgttgagactactgaagtagagaaaaaagtcatccacccacagttcattctggaagtctacaatctagggaacaagaactaagatacatgtgtacctataatttatttatttatttacttacttatttttgagacagagtctcgctcttgtcgcccaggctggagtgcagtgactcagtgatctcagctcactgcaacctccacctccccggttcaagccattctcccgccacagcctcctgagtagctgggattacaggtgtgtgccagcagacccagctaatttttaattttttagtagagacggggtttcaccacgttggccaggctggtctcaaattcctgacctcaagttatctgcccgccttggcctcccaaagtgctgggattacaggtacaggtgtgagccactgcacctggtccccatgtgtgcctctaatttaaagaggtgtcatgtcctaggggagtgatcattagcccttcagggtaggggatggacagggaatgggatagaaatgggggattaggtaggcaagtgtgtactacaattaaggagaatccttgagctagaactgttatccaaagtgtaatcgagaaccacatgtggctatttaaatttattaaaattaaatttaaaattcaattcctcagtcataatagccatgtttccagcgcttaataaccacatgtggctggtgactatcatgtcacagcacagatataaaacatttccatcactacagaaacttggacagaattttgtcacacatatttcttactttcatgcaatgtgagacacttctgtgacagatccgaagttgtatttttctttaatgaacacccatttggctaacaaaactacagtttcactcaggatgcctgtgttttgttgttattgtttgatacagggtcttactctgtcacccaggctggagtgcagtggtgtgatcaccgctcactgcagcctccacctcccaggttccagtgattctcctgcgtgggactacaggcctgtgccactatacccggctgatttttaaattttttgtaaggacgaagtctccttgtgtttcccaagctggtctcaaactcctggcctcaagtgatcctcctgccttgcttcccagagtgttggttttacaggcatgagccactacacccggcttgaagattagttttgtatctaaagcagtatgaatttaaattgctgatttatgaaatacatgcatcaagcactttttaagacttagccaaacatttgtgtttaaaacatgtaacttgaatcaaaacgtagctttttttttttacctgccatgatgtctgtggccttgactgacgtatgctgtgaggatatgctggccaagtaggattctccatattcaagtcctttgacccatgatcatagctttaaaaaaaaattgtacactcttttaaaaaattgaagcaaaatccacataacataaaactggccgggcgcagtggctcacgcttgtaatcccagcactttaggaggccaaggcgggcggatcacaaggtcaggagatcgagaccatcctggccaacatggtgaaaccccatctctactaaaaatacaaaaaattacccaggcgtggtggcgcgcgcctgtagtcccagctactcgggaggctgaggcaggggaatcgcttgaacccaggagtcggaggttgcagtgagccgagattgcaccactgcactccagcctggcaacagagcaagactcaaaataaataaataaaataaaataaaataaaatgagtcaggaatgatgttggtgttgaggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgaaccaagaaagaaggcatatgcagatttctgcagaaattatgagattttgagcagatgaggaaggctggtatctttcagtttaaagtaatcttggaatataaagaatttcttcaggttgaattacctagaagtttgtcactgactcgtgttcctgaactacgacacatgaatatgtgggctaatagttcgtcttgataaacaattaacaaacaaataaataaagccattttaaagtgaacaattcagtggcatttagtacattcacactgtgttgtacaaccagcaattctatgtagttctaaaacatttccttttttttggagacagggtctcacaccgtggtccaggttggagtgcagtggtgcgatcttggttcactgcagcctccctccacctcccgggttcaagtgatcctcccacctcagcctcccaagtagctggcactacagacatgtgctaccacacccagctaatttttattttatttaatttttttgagacagagtctcactgttatgcccaggctggagtgcagtggtgcaatctcggctcactgcaacctccgcctcgcaggttcaagattgccagattctcctggctcagcctcctgagtatctgggattataggcacctgtcatcaccctggctaattcttgtattttagtagagacggggtttcaccatgttggccaggctggtctcaaactcctgacctcatgtggtccgtctgcctcagcctcccaaagtgctgggattatagtcatgagccaccgtgcctggcttgaaactggattgatagttaaaatttgattatggtgaagcaacacaaacaccacatattctatgattccattgacatgaagtattcagaagaggtaaatccacagagacagaaaacagacatactgttggctgccagaagctaggagagagtatgggcagtaactgctaaatgaatacgggtttccttttggggtgattaaaatgtcttggaagccgggcgcggtggctcacacgtgtaatcccagcactttgggaggctgaggtgggtggattgcttgagctcaggagttggagaccagtctggggaacctattgaaacaccatctctataaaaaatttaaggccaggtgtggtggctcatgactgtaatcccgggactttgggaggctgaggcaggcagatcacatgaggtcaggagtttgagaccagcctggcaacatcgtgaaacccccgtctctactaaaactacaaaaattagctgggtgtggtggcacacgcctatagtcccagctactcgggacttaaagcaggagaatcgcttgaacccaggaggtggaggttgcagtgagccgagactgcgatagtgcactccaacctgggcgacagagcgagactccatctcttaaaaaaaaaaaaaagatccagttccagtttatcatgtgtatcacaggcagtactggtgttctgctgttctctggtaaagtcttcacttcatgttttaaaatttgtggtaatgtaccaagtaccacagtcaagtcattaatcttcctttattataaattatactattagttttgcctctttttttttttttttttttttgagacagagtcctgctctgtctgtttttgagacagagtcgtgtcacccaggctggagtgcagtggtgcgatctcggctcactgccagctccacctcccgggttcatgccattctcctgccttggcctcccgagtagctgggattacaggtgcccgccaccaagcccggctaattttttgtatttttagtagagacagggtttcaccatgttagccaggatggtctcgatctcctgaccttgtgatccacccgcctcggcctcccaaagtgctgggattataggcatgagccaccgtgcctggcttttttttttttaagatggagtttcgctcttgttgcccaggctggagtgcgatggtgcaatctcagctcactgcaacctctgcctcccgggtagcttcctgcctcagcctcccaagtagctgggattacaggcacaagacaccgtgcccggcaaatttttgtgtttttagtagagttggggtttcctcatattagtcagactggtctcaaactcctgacctcaggtgatccgcccgcctccacctccagaagtgctgggattacagatgtgagccaccatgcccagcctagtttttcctcttttttttttgagacagggtctcactctttcacccaggctagagtgcggtggtgcaatcttggctcactgcgacctctgctacctgggctcaagcgattctcctgcctcagtttcctgagtagctgggactacaagcatgagccaccatgtctagcctaattcatatatatatatatatatttttgtgtgtggagatggggtttcaccatgttgcccaggctggtctcaaacttagtttttccttgtaatttggggcatggcagttgcactcagtggtaaaccctgaaagctttcccacttagaaaaaattgttccatttttaaatagttaataaaggtgtgtttctaaacatagagataacactggaaaatttgaaactgtaatttcattccttgagagggttctaacttcctttactagcagctgtgaaccatgtaggatgtgagaaattacaccctaatcatctatttcctagccatgaacagttcaacctcggaaaattctaagcccaggctcattagtagccagtaaaatctggatgttatgtgagtcatgaataagaccagagtagaatgaacaagtaaaggtttactgtgtatgtatgaagatagggtagaaatatatcggttttatttttattttttgagacagggtgtcactctctcgcccaggctggagtgcagtggtgtagtcaggactcattgcaaccttgaccctcccaggctcagcccccggagcagctgggactgcaggcgcatgccgccattcccgacagttttttgttttttgttttttgtttttctttttttggtacaggtggggttttgccatgttgcccaggctggtctcaaactcttgccatcctcccaccttggactcccagaggtttaggactacaggtgtgagccaccatgcccaacccatttgcaacttacaatccattgtaagttgaggagccatctgtattgtaaatctaatagttggtgccaggaactaagtggtcaggtgtaagtactgttttgttttgaaaagctgttacagttagtgatacacttgagagtggtgaggaagcccaccacacccgtcattttcctgccttaagatacgcagtacatcataactgtgtgtccgtcagagcttagtttacttgtacactgattttcagcagggactatctgaggaaggggaagatggcacttgcataacttggaaatgcctgcagttgattctgatgtgcctgtatgttagatggtagtgattacaggatctgtttcctaaggcttttggtgggaatgagctagcagtcggcacttagggctcaataaaaattagttaaagcaaattgctaccccctccatcccccactccctacacaatatggatttgtgagtacttttatccttgtctggcccataatagatactcaatacatatatatatgtattcatttttattaatttttttttttttgagacggagtttcattcttgtccaagctggagtgcagtgacgtgatcttggctcactgcaacctccacctcccgggttcaagcgattctcctgccttggcctcccgagtagctgggattacaggtgtatgccacacccagctaattgttttgtattttcagtagagacagggttttgccatgttggccgggttggtcttgaactcccgaactcaaatgatccccccgcttccgcctcccaaagtgttgggattacaggtgtgagccaccgtgcctggctgatactcaatacatattgataggattgagttggagtagttacatagcagatggagacacatttgttgaatacgccaggagttctttaactgacactaaacaaattattctcccatttcctcccataaactcctcaacaatcctctcaggtagatggtatatcatttccacaatttcagtggaataagtgcatgcacagcttgtaataagccaggagttaaacctaggagtcagctcagttccaggctctgagaagtaccccatgcagtcacctccttcttagggtggcctgtgaacttgatactctcagtactacctggcttcctctgaaaactgagtaatttttccttaccttatccttaaacttttcttgaaaatggaaaagcaaaaaaaagttaatctgtattgtgttgaagtacagtttctgcctccttccaaaccaggttcaaatgcgtttcccccctgtttgttaatgtcctgctcatcccacagcttggggtcatcttagaccttttactctccctttctcccaactcctgtcaggtgtagcccccatcccctcctagttgtattgcttggttgtctccatggcatgctttcttgcagtggtgatgtgggtcttcctgcctgtggggtcttgcccactctagttcatgtagtttaagctgcaagaaaaagatcttcctaagtgacagtctgagcctgtcacttaaaaaaaaaaaagaaaacaatttggttgtcctttacctatcagggacaggaaattactttactcaacatttgatgctattgaaggttgggcccaaaacactttctcttgactcttacaggtattgatccttttcgggcaatgattttacaggttacaaattcattattttttcatacttgctgtgcatgattcatatgatttaattctttagtatcgttttctgtcgtggagattctttaaagcaggggcacgttcatattggagtataatttaggtttgtctgtatctgacaaactaaaatccaaaaagcagacttagatatttggttattagtatgtatttctcctacatctcttccagtaatgtcataagtaaatttgcagtgtggcaactggaaactggattgttgcttggttttagagttctagtataggaaaaaactggcatcattggaatcaccttttctgcagatatttttaatggcttatatatgtttcaggactttatacacatgtcatttatcttataggtatctaatttattcagggattttgataacatgagtatggaatattaaaaagggctaatcacaggctggatgcggtggctcaagcctgtaatcccagcactttgggaggccgaggtgggcagaacacctgaggtcgtagttcaaaaccagcctgaccaacgtggcgaaaccccatctctactaaaaatacaaaattagccgggcatggtggcatgcacctgtgatcccaggtactcaggaggctgaggcaggagaatcgcttgaaccggggagatggaggttgcggtaagccaagatcgtgccattgcactccaactccagcctgggcaacaagagtgaaactcagtctcaaaaaaaaaaaaaaaaaaaaagggctaatcacagctttcttgggctgggttacctagagagaatcacgggaagtagatgtgtatttgttgagcacatctctaatttgatctgtgctgagctgcaaattactttgacagtatctgtgaagaaaaggtttataaagcaaatcaaaagaataagcatgtttttatgaatacattgaaactactgaaaatgtttcaaaattggctgtaattagtagaattttgaaaagtaggttaagcagagacttctaacttgaaggcctgagttagctgccattgatctggggttattgattgaggcttgtgtcgtgttattgaacttctgtttttactgcatattaaaagataagtgaaatggatggataagtatcaatttttaatagaacttctttctgttaaacagcacctgtggaatcctctcaagaggaacagtcattgtgtgaaggtaatgatgtactctttgaaagtctacttgagaaaacattaggttgtctatatggtgtgtaaagctagatactgtttggtaaatatatattatatttcaatctcttgtctaggttcaaattcagctgttagcatggaactttcagaacctattggtaagaaaatttctgaccatattaatacagtaatatgaaactctttcactctcaagatttaaggtgcattatgtaagttacgattattgtaatgcctacatttaagacacattgagtctttgctattagtatttagaaagtagaacaaactaggcactaacactgccttgataaacttaatgattgcaaataaaattgagtggaggaatggtcaagtcaatttaaatacctgtacctgttctgttttctttttttgagacggagtcttgctctgtcgcccaggctggagtgtagtggtgcaatcttgggtcactgcaacctccgcctcccaggttcaagcgcttctcctgcctcagcttcttgagtagctgggattacaggcgcacaccaccacaactggcaaatttttgtatttttagtagaggcggggtttcaccatgttgatcaggatggtctcgaactcctgacctcgtgatccacccacctcggcctccgaaagtgctgggattacaggtgtgagccaccatgctcggccacacgttctgttttcttggtgaaaaatgttcttcctttttataactttattcttaagggtttcacgttctcagcgtgattaaagttgatgccaaagttttattagtttaagaggaaaaagaaaatatttcctaaatcctttcatatttctcgtgtgtcacgattttaaactttcctttttttcttactatcagggtgtctcaacactggaataactaggctgttgggaatgttagaactcttgtttgcattttgtttgccattatgaaaatgaagctttgctaaaatagcaatctcagcctgtgagtcagtgccctctgatgtgataccagcagtgagtctgccttgaaagctgtcacccatttctgctatgaaagaggttttcctgcttatgtgtcactaggcattaggaaatggaactacatatgcaaacttccatttgttgttttaaagctagtgtattttaaagtatagattgtaagtctttttcagaatactaagttaaaatgtctttcttcagtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaagcaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcctatccccagaattgtgagaaaaaaaatacagaattatgtgtctttcatttcagctatctctgccttccccccagatatgaaacactgtaccccttcttttagtagcaagaactcttttgaaagtgtaaaggagcggctgggcactgtggctggcgcctgtaatcccagcactttgggaggccaaggcgggcacatcacgaggtcaggagttcaagaccagcctggccaacatggtgaaaccccgtctctactaaaaatacaaaaattagccaggtgtggtggcatgagcctgtaatcccagctactccggaggctgaggcaggagaattgcttgaacccagaaggtggaggttgcagtgaggtgagatcgcaccactgcactccagctctgggcaacggagcaagattccgtctcggggggaaaaaaaggtgtaaaggagcacatacctcatttgctgtaagtgaaaggaaaagcacctgaatctagttcacagttcttcagctgcttttgctcttggaaacttctcttggggaatttacagtctgttgccgctgtgctttcggagtaatctgttaaaaaattctttatcagtaaagtgtttttaagtggttttttttttttttttgagatggagtttcactcttgtcgcccaggctggagtgcaatggcgtgatttcagcttagtgcaacctctgcttcccgagttcacgcgattctcctgcctcagcttcccaagtagctgggattacaggcggccgccaccacgcctagctaatttttgtatttttagtagaaacggggtttcaccatgttggccaggctggtctcgaactcctgacctgaggtcatccgccctcgctggcctcccaaagtgctggaattacaggcgtgagcaccgagcccagccttgaggctcattttcaaaaggagaagggtaatgaactaggatttatgccccaaattcatatggaagatttaattatgtatgttaaagggtgctgttgtttgcatatttagccattggtttttggttttaacctatggtttgcatgttgatgttacttttagatgctggcaagtcaaccattggaggacaaataatgtaagtctgtatcttttgttaaataacagagttaaattgatgtaatgaattttaggcattgtaaaccttcatacagtcacacaaaggagataaaacaggtcccccaaagaaaaattaaaaataaaattactgggacacaatactgatgttaagaagtgatttttggcctggtgtggtggaacacacctataatcccagcattttgagaggctaaggtgggaggatcactggacttgaggtctggagtttgaaaccagcctgggcaagacaatgagactctgtctctactttaatttttttaaaagtagtagtttttgtaatgtgattattactagtgttaaatgtgtttctgaaagctttttacattttttaaaaataaaaaatgaacacagaactctagattatgggaaacttggtctcctttgcatataacatacatgggaataatgacaaccagctcttgaatctggtgaatgggggaactgttttttcctcattcatcagctccttaaatgtatatggatttaataaaagacaggtagactagctaaaatgctaagataattttttgatcgtattatagaaatttcctaggtatgaaatgaccgtggctggcctttagtaatgcattttagtattgacaaatcttgataactaaaaagtcctaaatttttaattgcttctctaaattagacccatttctttgaactgtgtcatcagaggacctagagggcttgccatcatcttgcctagttaaattttttttttttttttttttttgagatagggtctcattctgtcaccaaggctggagtgcagtggcatgattttggctcactgcagcctcgacctcctggactcaagcaatccttccacctcagcctcccaagcaggtgggatcacaggtgcatgcaaccaagcctggctaatttttgtgtttttttgtagaggtggtgtttcatcatattgcccaggctggtcttgacctcttggggtcaagtggtctgcccacctctactgcctcccaaagtgctggcatacaggtgtgattaaccacacctggctaatcatcattggtaatcttgccagttacttttgaacatttccacaacagagactctaagacaggctgttaaacaggggtccttccccaggtctctgtggttgaagtgtcacagccatatgatgttatgtttcaggacagtgtatattttttgctgatgggctgtaagttttggtggcgtcacactgggtttctacatgcaaatgcttaggtgcactgcactatagatgtctacgtggagaacacagatgaaagctatagggaaaggagagctttgaattggattgagtcaaggaagtatgcattactaacgaactattttgaaattattatctcattttgacaagtaataagacttacttgcctagacaacattgttgcaatttttttttcttttctatagtacctacatttacatttacttgttattttatttttaaatttacttggctgggcatggtggctcatatctgtaatcctagcattttgggaggccaaggcggaaggatcatttgagcccaggcttcaagaagagccaggacaatatagtgagaccctcatttctataaaaaataaaaataaaactatatttattttaagagacagggtctcgctgtgttgcccaggccggagggtagtggctatttataggggggaggatgatagcgcactatagcttcaaattcctgtgctcaactgatcctcctacctcagcctcccaagtagctgggactacacgcttgcaccaccatgcccaccttatatttacttaaaaaaaacaaacaaaaacaaaaaacaaaacctactatattctgaaataattttagatttacggaatggttgcaaaaacagtacgggaagttcccttcattcatcctgccctgatgttgacatcttataaccatagtcattcatcaaaacttccttattactggtgaaattagtcatgattacttggttaaggtgtcatctgtcaagattgtccactataaggttattgttttcccttttcttttctttttttttttttttttttttgagacagaatctctatcgcccaggctggagtgcagtgcagtggtgtgatcttggctcactgcaacctccgcctcctgggttcaaatgattctcctgcctcagcctcccaagtagctgggattacaggcatgcaccaccacgtctggctaatttttttgtatttttagtagagatgaggtttcaccatgttggtcaggctggtcttgaactcctgaccttgtgatccgcctgctttggcctcgcaaagtgctgggattataggcctgagccaccgtgcccggccattttttattttttgttttttttgttttttttttttttttgagaaagggtctccctgttgtttaggctggagggcagttgtgtaatcatggctcactgcagcctcaacctcatggactcaggcagtcctcccaactcagcttcccaaagtgctgagattacaggcatgagccatcacacctggcctgattttttgttttttttagagacagggtcttgctcttaaacacaggctagagtgcagtggtggaatcatagcttactgtaacctcacactcctgggctcaggtgatcctctcacttcagcctcccaagtagctaggaatacaggcatgcatcaccacaccaggccaattttttaatatttatgtggagatggtctcactgtgttgcactggctggtctcaaactcctggcctcaagggatcctcccacctcagcctcccaaagtgctgggattacgggcatgagccatcacaccaggccactttgtctgttaattcgagactgtaaatatcctttttccacttacactttccataattttagcatccaccagtggttcctttactttaactattttctggccaggcgtggtggttctcatgccagtattcccagcactttgggaggctgaggctggcagatcacttgaggtcaggagttcgagaccagcctgaccatggtgaaacccagtctctactaaaaatacaaaaacttagccaggcatggtggcacacgcctgtaatcccagctacttgagaggctgagacaggagaatcgcttgaacccaggaggaggaagttgcagtgagctgagatcacgccactgcactccaccctaggcgacagagcgagaccctgtctcaaaaaaaaaaaaaaaatatggccaggcgtggtgctcacgcctgtaatcccagcactttgggaggctgcggcaggtggatcacccaaggtcaggagttcgagaccagcctggccaacgtaatgaaaccccatctttactacaagtacaaaaattagccgggtttggtggtgggtgcctgtaatcccagctactcaggaggctgaggcaggagaatcacttgaacccaggaggcagaggttgcagtgagccgagattgtgccattgcactccaggtggatgacaagagcgaaactctgtctcaaaaaaaaaaatatatatatatatgtaatatatatattttatataaaaatgtgtaatatattttatataaaaatatgttatatatgttatatatatattttatatttttttagacagacacacacatataaaataactattttctgacgttgaaattttcgacaattttcacgttttcctaattccactgagtaatttgtgagtaattgtttacttttttttttctttaaatgttttcaggtatttgactggaatggttgacaaaaggacgcttgaaaagtatgaaagagaagctaaagagaaaaacagagaaacttggtatagtaaacttttatgacacttataaattacttttaaggagacgatgcccacttagtgcttttggagcctgttaaaatataaattgttgaagtctaaaatcgtatcacaacaaaggaaatttcccctctcctcataatacacagtagatgagttcctaatgctttaataacttacacagagaaatttggaaacaatccatatatctggtgatagacttgttgaaaatactataaaccatccatttaattgggtgattttgcaaccactgaaaacttacatttacataatttatagtaaccatgaatagaacttgcgttgtggtggcagttggggggaagcaggaaacatccctgtacttaagatatgaccattatataaataaatgctggaaataaaatggaatggaattattgacagtggttgcctttgaatggtgagacagtcaacttttttgttttctaaccttgttacttttatttttaaaaagttagcaagccttacctcaatgggatattgacagtcatttttttaaaataaaattatattcctctaaaataagtgggagaaatgctagtcagtgttgttataaaaaattgaggacatgctgtgaagatgatgaggtaagctaaattaatgcccactattacggatggtttgaatttatatgaatttttgcctggcagtgtgatattgaagcaatttttagcaagtaaccattgctcccacatggtgcgttagtggctttcagttttcaaaaatatctgaggacagttattttttattttattaaaaagttttagtcctggcacagtggcttaagcctgtaatctcagcactttgggaggccgagacgggcggatcacgaggtcaggagatcgagaccatcctggctaacatggtgaaaccccgtctctactaaaaatacaaaaaattagctgggcaaggtggcaggcacctgtagtcccagctacttgggaggctgaggcaggagaatggcgtgaacccgggaggcggaggttgcagtgagccgagattgcaccactgcactccagcctgggcaacagagtgagacaccatgtcaaaaaaaaaaaaagaaaaaaggaaaacaacttttattgggccaggcgcggtgactcaagcctataatctcagcactttgggaggcaaggcaggcagatcacacctgaggtcaggagttcgagaccaccctggccaatatggtgaaaccctgtctctactaaaactacaaaaatggccgggcacagtgtctcacgcctgtaatcccagcgctttgggaggccgaggcaggcggatcacctgaggtcaggagttcgagaccagcctgaccaacatggagaaaccctgtctctactaaaaatacaaaattagctgggcatggtggcgcatgctctaatcccagctactcggggggctgaggcaggagaatcacttgaacctgggaggcggaggttgcggtgagccgagatggtgctgctgcactccagcctgggcaacaagagctaaactccatctcaaaaaatatatatacaaaaagtagccgggcgtggtggtgggcacctgtaatcccagctacttgggaggctgaggcaggagaatagctggaacctgggaagcagaggttgcagtgagccgagatggtgccactgcactccaacctggccagagcaagactcccatctccaaaaaaaaaaaaaaaaaaaaaaaaaaaaagaagaagaggggtgggggtgccgggcacgacctaggctctgttgcccaggctggagtgtagtggctccatctccactcactgcaagctccacctcctgggttcacaccattctcctgcttcagcctcccaagtagctgggactacaggcacccgccaccacgcctggctaattttttgtatttttagtagagacagggtttcaccgtgttagctacgatggtctcaatctcctgaccttgtgatctgcctgcctcagcctcctagaatgctgaaattacaggcgtgagccacagcatccatccaaaaaagttttattattaccctttaactctcaagacagccattatttgtgttgtattttgtgccatgtgagtataaaaatgaagtaataagggagctcattatcacttaacacacagtgatattggcatttgtagttagtctttctgtgtagtcaacttgccataaagttctagatggtataattgactgcgtttatataaaagctctaagggtttgaatcaaaataatacattctttcagttttattttatttatttatttttttgagacggagtctcactgtgtcaccaggctggagtgcagtggcgcgatctcagctcactgcaacctccgcctcctgggttcaagcgattctcctgcctcagcctcccgagtagctgggactacaggcgcccgccaccatgcccagctaatttttgtatttttagtagagatggggtctcaccatgttggccaggatggtctcaatctcttgacctcaggtgatccgcctgccttggcctcccaaagtgcttggattacaagcatgagccactgcacctagccctttttttttttttttgagagacagagtctccctctgttgcccagcctggagtgcgatggcacgatcttggctcactgcaacctctacctcccagcttcaagcgattgtcctgcctcagctttcgaaatagctgtgactacaggtgtgcaccactatgcccaacttttgtatttttagtagagatgaggtttcatcatattagccaggctagtctcgaactcctgacctcaggtgatctgccagcctcggcctcccaaagtgctgggattacaggcgtgagccactgcgcccagccctattctttcaatttctttgttttcttttgagacggagccttgctctgtcgcccaggctggagtgcaatggcacggtcttggctcgctgcaacctcctcctcccaggttcaagcgattctcctgcctcagtctcctaagtactacaggtgggctcctccacacccagctaatttttgtattttcggtagagacagggcttcaccatgttggtcaggctggtgtcgaacccctgaccttgtgatccgccgccttggcctcccaaagtgctcagattacagatgtgagccaccgcacccggctcaattttcatttcaccaatcttgttcgtgatttaggtgttgtgtgtcatccattatatctttaatggtgaagaatatcctaaaaactctgatgttcttaggaatattgttctttttttaaaaattatttcaggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaagaaagacatttccagtccatctgtatatttgttagtagccccgcttatatctttaaatttgaatttatcttctaaaagctcaaattcaggttgcagtgaaatataatgatgtacacggtcacagttttcatcatactaatctctcttcaagaaatcttcaaaatttgatttacttctgaaaatacgtttcaccttttctctcctgttgctattatctattaccatgtcagaacttagtctccattaaatgccaagcccaccgttaggcaccatgggtaaaaaatgaataggaaaccatctgtttcatacggtcttcagtcattttgcgcttttcacaatgtactggtagtagatcacaattttttttcctttgtagttacaatagctagaaagtaaatgttggaattttaaaatatgcaggtatactagattttgggaatgtgggggattggaagcatctagacattgtttgatttgtgacattcaaaagcaggtacgtcataactcgtttgcttctattttcttgcaaaaaaaaaaaaaaaaaactcgtgatataactgaaaggaaagatgttttactgccataagggtatgcctgaaggcgaaggagtaaactgtttcctttcttggaattaggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagaggtgagcgtagatgtctggtattttatgttagtgggattaaggatggttttgttattgtacgactttttctctagggtttttctaaaccttaatctgtttacttaggaaactagagttcttggtttacattataattgagttattttggttacattataattgcagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacatgtaagtaactgttttttcctttttttaaaaaggaaaaggatgttattacttaaattacttataaagacatatgctgagtaacatgttaacatatgcttttgagcatatatctttataagtaatttaagaaaatattaaatgtaaccttggctttaaaaatactaagatctttgcccatttttaaactgggttgtcattttgttactgagtcctaagagttctttttaatactggctaccagtcccttatcagctacaatatgattatagcaagtattttctcccactttatggattgccttttttcacttctcgatggtgtcctttgaagcacaaaaggttttatttttgaagttttttacatttagatatgtatttgattttgagttaacttttgtgtaagatgtaaggtctatgtgtaggtttgttttgtttttgtatattaattgtttacacacaatttgttgaaaagactattcttttttcattgaattgatttggctccctctttgaaaatcaaatgaccataaatacgagtttattcttgaactccgtgtttcttttttttggtttgtttttttgaaacaggttttcactctgttaaccaggctggagtgcagtggcatgatctcggctcactgcaacctctgcctcccagctcaagagatcctcccacctcagcctcccaagtcgtagggactgtaggcacatgccaccgcacccggctgatttttgtatttttagtagagacagattcaccatgttgcccaggctggtgtcgaactcctgggctcaagagatgcacctgcctttcggcctcccaaagtgctgggattataggcatgagccactgcacgcagccaatactgtatgtttaaaggggaaattattttatagaatcttggtttcatagctggaaaagtccataaaaagtaatatagtcaatttattacatgtaggctatttgctataaaatatttctctaaattttaataagtttatgaggaagccttatactgagcagttttataatagttttctgtggaataagtgagatgaaatggataataaagtggttgaatgggaagaatacatgagtagaatgaaaatattattagaagctgtttatagtcatgtaacttaacattttgatatttatgttgacttcctttaatggctttgttgttatgttctcagtggattaccgtttattccatatctggataatttgccgaacttcaatagatcagttgatggaccaatcaggctgccaattgtggataagtacaaggtacccaaaatgttaaagaaattgggtttcctgggaggggaaatcattgttgtgcattttgtttctagttttgaaaactttttttcttttcttttctttcttgttttttttttgacagaatcttgcactctgtcccccaggctggagcgcagtggcgcgatctcagctcactgcaagctctgcctccttggttcaagtgattctcctgcctcagcctcctgagtagctaggactacaggctcccgccaccacgcccagctaattttttgtatttttagtagagacggggtttcactgtgtcagccaggatggtctcgatctcctgaccttgtgatccacctgcctcggcctcccccaaggtgctgggattacaggcgtgagccaccgtacctggccttctttttttttttttttttgagacggagtctcactctgtcacccaggctagagtgcagtggtgtgatgtcagctcactgcaacctctgcctcccaggttcaagagattctccagcctcagcctcctgagtagctgggactacaggcgtgtgccaccgcatccagctaattgttttttgtatttttagtagagaccggttttcaccatgttggccaggctggtctcgaactcctaacctcaggtgatccgcccgccttggcttcccaaagtgctgggcttacaggcatgagccaccatgcccggtccaaaaactttattaacaacataacattgatgtctttttcttaatggctttatattagtggtatagatagaccataatttattcaacaagtttagtttattttagctgtttcccgatgagccagggatcatatcttagtgataaactcatagatgtaactgctgggctcaaaggattttcttattaaagttgatgcatattggtaaatagcatcgcaaaaatactgtgctaacttctgtcaccactagcagcatgagtgttagttttaccacagcctcaccagcactggatgttcgtcttaaaaaaaataaacttccttgtttttaactggatttccaacttgaatttttaagttttgcggtatcaatgtatgtaatgttttcccctcctcaaatacattattctttaattagctccgttctaaatttctttaacaagtattgctttttccaattttatatatgaggaaacaggcctagagatcaggagaacctgaatttgtacaaacagttcagatcttccaacataaacttctgtgttgttttctgcacctttttttttttttttgagatggagtctcgctgtttcaccaggctggagtgcagtggcatgatctcggctcactgcaacctccgcctcctgggttcaagcgattctcatgcctcagccttccgagtagctgggattataggcaggtaccaccacacccagctaatttttgtatttttagtagagacggggtttcaccatgttggccaggatgggctcgatttcctgatcttgtgatccacccgcttcggcctcccaaagtgctgggattacaggcgtgagccactgagcccagcctttttttttttttgagacagagtcttgctcttttacccaagctggagtcgagtggttcagtctcggctcactgtaacctctgcctcctgagttcaagcgattcttctgcttcagcctctggagtagctgggattacaggcattccaccgtgcctggcaatttttttttttttttttttttttttttgtatttttagtagagatggggtttcgccatattggccaggctggtctccaactcctgacctcaggtggtccacccacctccacctcccaaagtgttgggattataggcttgagccaccacatccagcttgtgccattttctttttaaattataggcatactgaattattaatatgatcatacatatgcttatgacacaaattattatagagtatttgttactgagtttaagatgaacctaagccttctacttaagcaaatgattttcctttatgaataagcagtgtagaatttcactttgggctattgagctgttatacagcaccaagaagtctgaaactggattttattttacatttgatcaggatatgggcactgtggtcctgggaaagctggaatcaggatctatttgtaaaggccagcagcttgtgatgatgccaaacaaggtaagaatcggttatgctgtttcctatctatttattgattttttttctttttctttaagagatagggtcttcttctgtcaccgaggcaggagtacagtggcgcattcatagcttattgcagcctcaaactttcaagcaatcctgccacctgagcctcccaagtagctgggactataggcttgtgccactctgcctggctaattttttttttttttaaataaaaattgagatggggtctcactatgttgaccagactagtctctaactcctggcctcaaacaatcctcccatcttggcctcccaaagtgctaggattacgggcgtgagccatcatgcctggcctcctttgtgtcatttttgactgttcagttgctgagatttgcagataacctgaggcagggcttctctaacagctccaaagatgttgcttatgcaggaccacagacttgagtcatcagtaccttcagatggagattttgctagatttcagtgagaatttatttaccatgctaactccaggcagagtaaattagaaaaagaatccattatcaaatgtaatatttagacataattggcaccttacaaattgtattatctggtttcttgatgccttgtgcattggagatgagaatatatagtatcttctaaaatgtttacattttaaagcctactttttcctattatctttgcaacttggaggctaacatatgagtgaaaataattctcaggttgagttcttagttagttgttgctgctgttgttgttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttacaaaaaaaaaaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagaggcagctggtgggtgggccatgcctgtaatcccagcactttgggaggccaaggtgggtggatcacgaggtcaggagttcgagaccagcttggccaacatagtgaaaccccgtctctactaaaaatacaaaaaattagccaagtgtgtcagcgggtgcctgtaatcctagctacccaggaggctgagacaggagaatcgcttgaacccgggaggcggaggttgcagtgagctgagatcacgccactgcacaccagcacaggcgacagtgcgagactccgtctcaaatatcaaataaaaaagaggccagacttttacaataaaaaattcatggggttggcaacctacggaatgagagaaaacatttgccaatcatgtatctaaatatggggttaatatctagaatatatgaagaactcctacaagtcaacagaaaacctgaacaacccaattcaaaaatgggcaaaggactgcaatagacatttttccagagaagatgtacaaacagccaaaaagtacatgaagaaatgcctagcactgctaactattagggaaataaaaatcaaatccacagggctggacatggtggcttatgcctataatccctgcactttcggaaaagctgaggcaggaggatcacttgagttttgagaccaggctgggtctctcactatgtgtgagatcccatctcaattaaaaacttttttttggaaagcagagtaacacgtgttggcaaggatgtggagaatttggaacccttgtgcactgttggtcatgtaaaattgtgccaagtgccgtgaaaaaatatagcagttcctcaaaaaattaaacatagatttcccacataatccagcaatactctttctgagtatatacccaaaagagtctcagatatctgtataaacatgttcatacatgtattattcacagtagccagaaggtggaagcaaccctggtgtccataaaggatgatggataaagaaagcgtgttacatacacgtaatagaatattgcacagccttaaaaaggaagttctgacacaggccacaacatgaatgaaccttgaggacattatgctatgtgaaataaaacagtcacaaaaagacaaataccgtatgattctacttaaatgaggtacctggaatagtcacatttgtcacctgaaagtaggatggtggttgccagggttcgggtgaacggggagtttcagttttgcaagataacaagatttcagagttctgaatattggttgtacaatatttaaatgtattaatttaggtgtactattgaaatgtacacctaaatggttatgatggtaaattttgttacatgtattttatcacagtaagtaattaagggttaaattaaaaatggttattttttactttgatattttatgaaactgttctgagatacagattgttttttgttttttgttttgtttttttttttttttttgagacggagtctcgctctgtagcccaggctggagtgcagtggtgtgatctcggctcactgcgacctccacctcccaggtcccggttcaagcaatgctcctgcctcagcctcccaagtagctgggattacaggaacgtgccaccatgcccagctcatttttgtatttttaatggagacaggatttcaccgtgttggccaggctggtcttgaacttctgaccttatgatccacctgccttggcctcccaaagtgctggggttacaggcgtgagccactggcgcccagccgatacagattgttttttaggtgagtgacttctaaactcttgtttctttcttttttttttgagacggagtctccttctgtggcccaggctggagtacagtggcgccatctcagctcactgcaacctccacctccagggttcaagcagttctctgcctcagcctcccgagtagctgggattacaggtgcctgccaccacgcctggctaatttttgtatttttagtcgagacagggtttcaccatcttggctaggctggccttgaactcctgaccttgtgatccacccaccttggcctcccaaagtgctgggattacaggtgtgagccactgtgcccggcctttttttttattattattattattattttttattttttggagatggagtttcgctcttattgcccaggctggagtatagtggcacgatctcggctcactgcatcctctgcctcctgggttcaagcgattctcctgcccaagcctcctgagtagctgggattacaggtgcctgccaccacgccaagctaattgttttttttcttttgtatttttagtagagacagggtttcaccatgttggccaggctggtctcaaactcctgatctcaggtgatcacccgcctcggcctcccaaaatgctgaggcgtgagccactgcacctggcctgcatagcattattgatgtagtaaatgtcactgatggtaaatttcccgtgtatctcctctcaggtcacttgttcttttgcttcaccttgctgccacagccagcactggcagtactgaggagcaatactggcatcagaactggaggctccataactattttatttttacattaaaaactttttttttttttttttttaaagacagggtctcgctgtgtcactcaggctacagtgcggtagtgtgatcatagctcactgcagccttaaaacacctgggctcaagcagtcctcatgcctcagccttccaagtagcggggctaaaggcatgtggactacccagctccgtggactattttgttagaaacaaagagtttaggccgggcacagtggctcacgcctgtaatctgagcactttgggaggccaaggtgggtggatcacctgaggtcaggagtttgagaccagcctggccaacatggtgaaacctcgtctctactaaaaatacaaaaaattagccaggcatggtggtgggtgcctgtaatcccagctacttgggaggctgaggcaggagaatggcttgaacccaggaggcagaggttgcagtgagccaagatcgcaccactgcactccagcctgggcaacaagagcaaaactctgtctcaaaataaaaaaataacaatgctatgcagccatcatcactatctaattccagaccatttcattacaccaaaaggaaatgatgtattcattaaatagttgatagacttttaaagcttagttcaataatttttaagtagtgcataattccgatatttggagattgataggtaatagaagacaggtttattaaatccttcatagaattccataataataaaaattatatccataaaactgaaatccaaatattaaattgtgttttcgattttgaaaaggtaaaaaaaggcaaatgctagtgtatacagtgttctagttggaaatgattagaatgtgatatttaaaaggtgacacgttaatactttaattggcagttatacttctaggatatgatttttgctgatcatatctaggctaagattttatgtcatacaaacataagtgtttacagtcaaatcttgcaactcttattgagcagacagacattcagatcattttatgttgcgtaatgcagtgaatgtgtcagaaaacctccagtcttgttttcttttaaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccaggtaaacaaattattgttgttgtcatagtgggttttaatgtctaaatgaaattagaatatcagtgccttttgtcctgattatttgtgacatgccagttaacccatcttagtgtagagaaggggaatggaaatattataagccacttatatatcataaccacaataggcacctcatacaaggtcttcaagctggtacaagtgcttactggataaggagtattctttgtaagttcctttttatgtttgatctcctgatgatacattctacagtatctaatattcactttgaccagagcacagttactgtggaagtcatggtttatgtgctcattgacagcacatagctttccagacaagaaatcacacaggtttccctgttattaacaatctaacctccctgggagaatgacagagtaagtgactggtgtgaataacagaattttttaaagttcttttctaaggtatgacaactaatcaagttagattttgatgccagatgtaaggttgtttactttactggaccttggatattgagaaatggataaagctggataagtttacatctaggtagcttctgagcggtaaaaattagcttagttccttggggaatataaggaaagtcttcccagataagaaagttggcctgctgtcttttgttttgtttggagatggggtcttgctctgtcacccaggctggagtgcagtggcgcgatcttggctcactgcaacctccacctccgggattcaagcgattgtcctgcctcagcctcctgagtagctgggatttaggcgcccaccaccacgcctggctgattgttttgtatttttagtagagacagggtttcaccatgttgtccaggctggtcctgaactcctggcctcaggtgatccccccggcccccctgccgcctcggcctcccaaagtgctgagattacaggcgtgaaccactgcgcccagccagcctgccgtattttgaaagttgaccagggacttgccaagaagataaatacaggataagatactgaaattcatgctttgaggtcaagcagcctgacccatcctgtgaacaaaattagtaagacaaacctatcacctctaacacaaaaatcacttaagttgatgtcctagtgagatggtaacactaattcttgggatttatatggcgcttgagaacattgaattcttatttaccctaaggctaaagataagaatgtgtgtgtttgtttgacagatagtgattatagagcacaaatccatcatctgcccaggctataatgcggtgctgcatattcatacctgtattgaggaggtggaaataacagtgagtttaagataattggtttatttctgttttaatactgttttatcttcataatttctaatcagcaacagtgatgcacttttatttctacacctgttcttaaagattattttatttggcattattctgattttctcatactcttttcttggttaggccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagagcttttaaactgacgtctagtagtatatccaggatacctagctttggtcatcttcatcatctcagtacagtacacattgcaacaggttcacagaaaacttcgattcacattcttattcgtatgagtgttttatgagttgaatgtattgaacagaattgaccacgtgctttagtagtaatgccaaatctagtaatgctctacgtgaagaatcttaattttgatgttttgtgagtagtggatttggagggctattttgtttactaagatatttctatgatgtaatcctttgtaatatgtctagcgattaaaaggaacatagagattgatttttttttttacacctaatttttcagaggtctaatctttgtgaccttttgtgtgcatccatttctgcctacctctgggtgacgcagaacaactaacattcccatcttggggtcatgaagttctttggcataaaaacaaaatgattgttatgaaacgtttccttatgagcttttaatattcctgtccttttcctttccctttccctttccctttcctcttccctttcctttcctttttttgagatggagtctcgatctgtcacccaggctggagtgcagtggcaccatcttggctcactgcaagctccacctcccaggttcacgccattctcctgcctcagcctcccgagtagctgggactataggtgctgccaccatgcccggctaattttttgtatttttgtagagacggggtttcaccacgttagccaggatggtcttgatctcctgacctcgtgatccgcccgccttggcctcccaaagtgctgggattacaggcgtgagccaccgtgcccggcccagctgttaatatttctaacttagataaccattttaagactatagaagactttacataaaactttatagttccattgaaatacagaatagtcatttcacatgttcattccaattccatttagcaaaaactactttgtatctacaaagtgtcaggaactgtgctaagccctggtgatgaatacagttcctgaactttacattggatgaaattgtataaagacagtgtttattttactttaaaggcccagaactcttctggttgatagtaaaactggttattgggtttatcttattaatataacaaaatgatagttttagtttaccactcagaacctgataaaatcaggaagacagaagaaaagcaattaatgtagcaggaattcttaaccctagaattattttttcctaaaagctaacttggctttaaaaaaaaaaaaaaaaaaaaaaaaaaaaaaagctaacttggcttttaggttttccacaagacccaatgggttttgtatcctttcagtccacaggattactaccagaaggacgtgttcactgcactgtagtcagtggtgattgctgtgccttttcacagttacttaaggataggttttgggatttttttttttagcagctttattgagatacaatttccataatatgaaattgacctgttttaagtatgtaattcaatgaattttagtatgtttacagaattgtacaaccatcaccatatactaatattagaacatttagaacacctaaaaagaaaccttacacctgttcataatcaccccttattcccacctccaccccaggcaaccatttttcaatttgtcttttatagacactccataaatagaattataaattatgtggtcctttgtctagtttattttacttagtgtgattttgaggttcaaccatgtaacatgttatttattcctttgtatcactgaatagtactccactgggtggatattccacaaatacggatattccctttttttatttttaatccaaagaggttttttggcccagtgtggtggctcacccctgtaatcccagcactttgggaggccgaggcaggcggatcacctgaggccaagagttcaagaccagcctggccgacatggtgaaacctgctctctactaaaaatataaaaattagaatgggcatggtggcaagcacctatactcccagctactcaggaggctgaggcaggagaatcacttgaacccagaaggaggaggttgcagtcagctgaagtcgcaccactgcactccagcctgggtgacagagtaagactctgtctttatgcagtggctcatgcctgtaatcccagcactttgggaggctgaggcgggtggatcacctgaggtcaggagttcgagaccagcctggccaacatggtgaaatcccgtctcaactaaaaatacaaaaattagctgggcgtggtggcaggcatctgtatctcagctactggggaggatgaggcaggagaattgtttggggggtacggggggagataggtttttgatacagggaaccatctctttaccagcccccccaaataagaccctcttattaagactacctaaatagaagtatcatgggtttggcagtaaagctagttaattagtaacttacattgtaaaaaatatttttgtgatttaaaataataagttttaatatcttatatagacttgctgttaactactgaaagatttttttaaaatttcatttctaggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctatgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcagcaactttcaactttaaaaccctttgtgaaaaatgtggttatagcactatagctctgattttaggatggttaaatgttatattcattgttggcctaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtatacgacaac

SEQ ID NO: 8743 - DNA, 48045 bp, Homo sapiens
gaggagatccgctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcgggtaaaggcccgggacgcgggaggaagtccggccgggcgccggagcccacatggcgtaggggtgcggtccgggggcgcgcggccctggggcccggtcggcacgtggggcgctgacagtggcgccgtctgcctgggtggggcgccccgagcccgggagccggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttgggtgggcgtttagagatcccaggagttggggaggacgaatggccgagttttcctttcaccttaggcccagccgagagagcgtcttctgctgcgttttctactattgaaactgtaattacggtttaaactgtccgtggcccccaaccgtcctgaaggaatcccaagatgcattgcagccttgtgatcgggcagaaacttggctatcaataccaagatctgttttacccttagcattgtgtacgcttctaaagtttacaaagtgccacaaagttaggattcctcacttaatgtgtgataggagactatattgatttgtgtctttttaaagtgaagcttacacttttatcctttgtcagcgacacgtttagagaattttcattgctgtaaaatcgttgaccttattcagattgcttggaataactcactgtgttcgtgcatcagtagttcagtctatttcttcagacacttgagcatttgttataatttaatagttctcacgtgtctttctgaccgtagctagtagacatacattttctaatccataaaatttcgagttaactttggtttttaaacatcttcccgtacttaggggttgcttaagtcgtaggtagcatgcttgcaggtgctgacgttgtaggaatatccggtgagtgaacttatgtattctcataatggtgcttattttgtggtaggtagcttgctttcaggtactgattttgtgggaatgtcaaatgagtgaacttaagtattctcttcctaatggtgcttattttaggaactatcagtgtttccttaaagagaaaatgaaaaaggaaggaaaaggctgaacgtcctttcatcatttagccaggacgttagtggggtgggtcatgacatccagcgcattttaagtgagaacatattgttgatttctctctttaaagttctgtattgtggtggttcttagataagtggacattataaaagtgctccaggagtttggtttctacagaaacttttgtcaccgtttgctctttcgtggtaaagggatagtgtctggagaaacactctgatgacgtatgtacgtcagcacggttgatttggtggttttgttgacagtggcatttatttgtgtgggtggttgatgttttcttttgaggagatcgagcactttcagggtggtacggctctagacaatgttttcctcttgaataaggaagcttagcttgtaattcttgacttacatcaagccattttgactgcctaacctagttcacttctcagctcctaaaagtgcccattccctaccttactttgcagattccgtttatccagccattttctttcttggctcttcctcctttctgtggagccaccagcaccactctgactagactcaggactccatttacagcctgtccagcgagtcatccggggataaccaaccttggtctagaatggtcactgttggtgactaggtattacctcttatgcgggctttctctcttcctgatagttgctaatttgtagttacacctaatctttttctctttgacagtgctagaaattggagatgcgaaaacctgtagggaagtagctgtcagtaagagaatccgtacagcatggtcaactttcttgtttttaatcaaaaaactattttggtgttaccgactttaccaattgcttgtaccaaaatgccagttcatgtttttaaaaaattatcctatgtaggatgtctatttggaaaagaactgattttctaagttgaggtccagggttatattgagactgttggattgcatgttccagactattaagtccataaaaagccagcatcggagaacaatcagtgcttataaaaagcagggggataaataggaaataacacctggattggaacttacaaagggggaaccaaaaagtttgcaaggtttttttgatagcgaggaagtggacaatagggctagcatgttctgttctttagttaagccatagccgaaatttgtgctgggtgtgtttttaaactgcatgccgggaaagctgttgaaggagcctggagagtcagaccttgggattcagtattgaccttggatctctttgaaaactaaagaatataggttccttaagaaataattaagtggaacccatttaagtgtaattaagtgtaattcatttaagcacagttctctagagccaagtaaattggccaagagattctccttaaaaagtgaggtccccaagtgaataaaaatatagaagacaaggcttaatgtatattagaacaagcattttatctgataggatgtatttaagttgcaatttgcacctagttttttttattgttagataagaaactggtttagtaattttagggttacttgaactttttagaacagccagagcttctaaagtaatgatgtggtgttctttgcatcatcccacctttaatgcttctcagaactcactgccattaagaaacaagcatggaataaaaccagcagccctcagtacttacttggaggaggcactgtctccaaaacttagcagattgtattgtggaacttgaattttaaagagaaacattctgttttgtagtgttccgtatttgctgaatgccttatttattggaagaggaggttttttttttgtttttttttttttttgagacggagtcttgctctgttgcccaggctggagtgcaatggcacgatctcggctgactacaacctcctcctcccaggttcaagcaattctcctgcctcagcctcccgagtagctgggattacaggcacctgccatcatgcccagctattttgtgtgtgtgtgtttttgcagggatggggtttcaccatgttggctaggctggtcttgaactcttgacctcaggtgatctgcccgccttggcctcccaaagtgccgggattacaggtgtgaccgcgcctggccttttttttttttttttttaaatgattgacatttaacttacacactgtaaaattcacccttttcaactgtacaagctgggcgcattggctcacacttataaacccaacactctgggaggctgaggtgagaggattgcctgaggcctccataaaacatagtgagactgagaccctgtctccacaaaaaaaaaaaaaaaaaaaaaaaaaaaaatacagctgggtgcagtggctcatgcctgtaatcccagcactttgggaggccgaggtggacggatcacctgaggtcaggagttcgagaccagcctggccaacgtggcgaaacctgtctctattaaaaatataaaaattagccaggcatggtggtgcgcgcccgtagtcccagctactggggaggctgaggcaggagaatcacttgaatctgggaggcggaggttgcagtgagccgagatcacaccactgcactctagcctgggcgacattgacactctgtctcaaaaaaaaaaaaaaaaaaaaatagctgggtgtggtggcacaaacctgtagtcccagctacttgggaggttgaggtgggaggatctcttgagcccaggagctggaggctgcagtgagctatgatggcaccattgcactcagcctgggtgaccaaatgagacactgtccaaaaagaaaagtaaagtgtacatacagttcagtggcttttaatatatttgtaaggttatgcaaccatcaccacttggcagatgctttttagaatattctcagttttaagctggaacatctcagaagtgacctcttcagggccaccagagtagagaggattccaaatcaaagtaatggttgtttaatccagaaaggcccttacactttattaatatgttaaattctatctgttgaggtagataataggtaagattctgtatttgagaatgtgtttttgagactgaagtgcctgcaagaacagtgctcatataaaggtgtttttaggcttcagtgggacagcagatggggtagaggagaggccccacagtatccctggagtatcacagtagtaaacactgcctttcgttacttctcctgccatggctgacctttttgtctcttgtttcatggttttacacgtatgaatggcttgagactgaggatttagggaagaagcgaaggcatcatctagggctgtgctgtgccaagttgagcagttgtttaaactgttagaatttttgactggtgtaaaaaccctctttggagcaggtattacgtagtgctgtcagtacatatcttattgcattcttctgttctttattttttaccttttctgaagttgcacagcgtgaaaagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttaccagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagttgcagccaaagcctgatcaccaaggttgtgtgtattttaaaaaactttttacttattattttttagagacgggatcttactttgtcacccaagctggagtataattgtgtgattatagctcatcgtaacttcaaatccctgggctcaagtgatctttcacctcagcttcctgagtagctaggactataggcacccaccatgacgcctggctaagtttttttgtttgtttttgttttttgagatggagtttcgctctgtcacaggctggagtgcagtggccctaactcggctcaccgtaacctctgcctccccaggttcaagcgattgttctgcctcagcttcccaagtagctgagattacaggtgcccgccaccacgcccagctaatttttgtatttttagtagagatgaggtttcaccatgttgcccaggctggtctcgaactcttgacctcaagtgatccacccgtctcggcctcccaaaatgctgggattacaggcgagagccactgtgcctggccaagttttgtatttttaagtttgtcgagagtgctgaaggtagagcactggttatctttttacagtacttgtctatttcgtattaaacagcagtgagttcagttactatgagtctggctagtgtgtctattggggcatgtttagaatttcatcattctacccttggttttaaaatatcttcgggagacaagaatttggctactagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttttttttttttttttttttttttttttttgagacggagtctcgctctgtcgcccaggctggagtgcagtggcgggatctcggctcactgcaagctccgcctcccgggttcacgccattctcccgcctcagtctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttgtatttttagtagagacagggtttcaccatgttggccaggatggtcttggtggctactgacctcaagtgagccacccacctcggcctcccaaagtgctgggattacaggtgtgagccaccgcacccggctgtttctgttatttttgtacttttttgagggtatctgaaatggttttggtttgtgtattttaaatgttatttaaatggttttttgtttcttttttgtttttgagatgaatctctctatgtcgcccaggctggagtgcactggcacgatcttggctcactgcaacctctgccttcctggttcaagcgattctcctgcctcagcctcccaggtagctgggattacacgtgtgcaccaccatccccagctaatttttgtatttttagtagagacggggctttgccatgctggccaggctggtctcgcactcctgacctcaagtgatctgcccacttcagcctcccaaagtgctgggattacatgtgtgagccaccgcgcctggcctcaaattgtttttgaagtagttaggttgtagctcataagactgtctttcagggttgtttgaaaaacataatggaattttagttactctatgcaaagtctgatcaggttgataatgtggcattgcttttgtgtccgaataaagaggttcttagaatgttagcgctggatacgaccctagcagttgtacagcctcttcattttcagataaaggaactggagccttagaaatgctaagtaaatgcctaaggtcactcacagagttaatgacaccattgagtctagaatgcagatttgctacctgctagtttagtgcttgatctgccacatcatgctgtttaataacagggggcgggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacaggagaaaaaaagaaaaacctcagcttgcaaatttttgttcagagatgggatcgttctttgttgttggagggatttacattaaaaaaattcaagaaatattgtctcatgtgatcttaccagataagtgcctattattaagacttgttggctgctggatttattatcttagcctaattttctttctgagttaaatgaatcttgcttttttatcgttaccaccctggcataatccaatgggaatatagtatgaaccacatagttaatttaaaattttctttctttaattttgttttttgagacagggtctcacattgttgcccaggctggagttcattggcacaatcatagctcactgtggcctcaacctcctgggcttaagtgattcttctgcctcagcctcctaaatagctgggactacagttgtatgcctccacgcctggctcatttttacatttttttttgtagagacagagcatcactgtgttgccctggctggtcttgaactcttggcctcaagcaaccctcttagcttggcctcccaaagtgctgggtttataggcgggaaccaccacagctggcccaacatctcctgagtgtagtgtttccctaaccccttcttagaaagttggcacatttaaaattgttttcactctcttgagccctaatggaaatgcaatgaatgtacagatggaggctaggggtcctggtcagaaaagggaagtgaggccagttgtggtggctcatgcctgaacccaggaggtggaggttgcagtgagcccagattgtgccactgcactccagcctgggcgacagagtgagactccatttcaaaaagaaaaaagaaaagtgaaaaaatgaagtgatgtgactggaaggaaccagtgtgaaaatcaaaggaaaacacagtaattcagtaaaaattgattgtgtatttattctatacaatacatcatgccaacttgttgagactactgaagtagagaaaaaagtcatccacccacagttcattctggaagtctacaatctagggaacaagaactaagatacatgtgtacctataatttatttatttatttacttacttatttttgagacagagtctcgctcttgtcgcccaggctggagtgcagtgactcagtgatctcagctcactgcaacctccacctccccggttcaagccattctcccgccacagcctcctgagtagctgggattacaggtgtgtgccagcagacccagctaatttttaattttttagtagagacggggtttcaccacgttggccaggctggtctcaaattcctgacctcaagttatctgcccgccttggcctcccaaagtgctgggattacaggtacaggtgtgagccactgcacctggtccccatgtgtgcctctaatttaaagaggtgtcatgtcctaggggagtgatcattagcccttcagggtaggggatggacagggaatgggatagaaatgggggattaggtaggcaagtgtgtactacaattaaggagaatccttgagctagaactgttatccaaagtgtaatcgagaaccacatgtggctatttaaatttattaaaattaaatttaaaattcaattcctcagtcataatagccatgtttccagcgcttaataaccacatgtggctggtgactatcatgtcacagcacagatataaaacatttccatcactacagaaacttggacagaattttgtcacacatatttcttactttcatgcaatgtgagacacttctgtgacagatccgaagttgtatttttctttaatgaacacccatttggctaacaaaactacagtttcactcaggatgcctgtgttttgttgttattgtttgatacagggtcttactctgtcacccaggctggagtgcagtggtgtgatcaccgctcactgcagcctccacctcccaggttccagtgattctcctgcgtgggactacaggcctgtgccactatacccggctgatttttaaattttttgtaaggacgaagtctccttgtgtttcccaggctggtctcaaactcctggcctcaagtgatcctcctgccttgcttcccagagtgttggttttacaggcatgagccactacacccggcttgaagattagttttgtatctaaagcagtatgaatttaaattgctgatttatgaaatacatgcatcaagcactttttaagacttagccaaacatttgtgtttaaaacatgtaacttgaatcaaaacgtagctttttttttttacctgccatgatgtctgtggccttgactgacgtatgctgtgaggatatgctggccaagtaggattctccatattcaagtcctttgacccatgatcatagctttaaaaaaaaattgtacactcttttaaaaaattgaagcaaaatccacataacataaaactggctgggcgcagtggctcacgcttgtaatcccagcactttaggaggccaaggcgggcggatcacaaggtcaggagatcgagaccatcctggccaacatggtgaaaccccatctctactaaaaatacaaaaaattacccaggcgtggtggcgcgcgcctgtagtcccagctactcgggaggctgaggcaggggaatcgcttgaacccaggagtcggaggttgcagtaagccgagattgcaccactgcactccagcctggcaacagagcaagactcaaaataaataaataaaataaaataaaataaaatgagtcaggaatgatgttggtgttgaggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgaaccaagaaagaaggcatatgcagatttctgcagaaattatgagattttgagcagatgaggaaggctggtatctttcagtttaaagtaatcttggaatataaagaatttcttcaggttgaattacctagaagtttgtcactgactcgtgttcctgaactacgacacatgaatatgtgggctaatagttcgtcttgataaacaattaacaaacaaataaataaagccattttaaagtgaacaattcagtggcatttagtacattcacactgtgttgtacaaccagcaattctatgtagttctaaaacatttccttttttttggagacagggtctcacaccgtggtccaggttggagtgcagtggtgcgatcttggttcactgcagcctccctccacctcccgggttcaagtgatcctcccacctcagcctcccaagtagctggcactacagacatgtgctaccacacccagctaatttttattttatttaatttttttgagacagagtctcactgttatgcccaggctggagtgcagtggtgcaatctcggctcactgcaacctccgcctcgcaggttcaagattgccagattctcctggctcagcctcctgagtatctgggattataggcacctgtcatcaccctggctaattcttgtattttagtagagacggggtttcaccatgttggccaggctggtctcaaactcctgacctcatgtggtccgtctgcctcagcctcccaaagtgctgggattatagtcatgagccaccgtgcctggcttgaaactggattgatagttaaaatttgattatggtgaagcaacacaaacaccacatattctatgattccattgacatgaagtattcagaagaggtaaatccacagagacagaaaacagacatactgttggctgccagaagctaggagagagtatgggcagtaactgctaaatgaatacgggtttccttttggggtgattaaaatgtcttggaagccgggcgcggtggctcacacgtgtaatcccagcactttgggaggctgaggtgggtggattgcttgagctcaggagttggagaccagtctggggaacctattgaaacaccatctctataaaaaatttaaggccaggtgtggtggctcatgactgtaatcccgggactttgggaggctgaggcaggcagatcacatgaggtcaggagtttgagaccagcctggcaacatcgtgaaacccccgtctctactaaaactacaaaaattagctgggtgtggtggcacacgcctatagtcccagctactcgggacttaaagcaggagaatcgcttgaacccaggaggtggaggttgcagtgagccgagactgcgatagtgcactccaacctgggcgacagagcgagactccatctcttaaaaaaaaaaaaaagatccagttccagtttatcatgtgtatcacaggcagtactggtgttctgctgttctctggtaaagtcttcacttcatgttttaaaatttgtggtaatgtaccaagtaccacagtcaagtcattaatcttcctttattataaattatactattagttttgcctcttttttttttttttttttttttgagacagagtcctgctctgtctgtttttgagacagagtcgtgtcacccaggctggagtgcagtggtgcgatctcggctcactgccagctccacctcccgggttcatgccattctcctgccttggcctcccgagtagctgggattacaggtgcccgccaccaagcccggctaattttttgtatttttagtagagacagggtttcaccatgttagccaggatggtctcgatctcctgaccttgtgatccacccgcctcggcctcccaaagtgctgggattataggcatgagccaccgtgcctggcttttttttttttaagatggagtttcgctcttgttgcccaggctggagtgcgatggtgcaatctcagctcactgcaacctctgcctcccgggtagcttcctgcctcagcctcccaagtagctgggattacaggcacaagacaccgtgcccggcaaatttttgtgtttttagtagagttggggtttcctcatattagtcagactggtctcaaactcctgacctcaggtgatccgcccgcctccacctccagaagtgctgggattacagatgtgagccaccatgcccagcctagtttttcctcttttttttttgagacagggtctcactctttcacccaggctagagtgcggtggtgcaatcttggctcactgcgacctctgctacctgggctcaagcgattctcctgcctcagtttcctgagtagctgggactacaagcatgagccaccatgtctagcctaattcatatatatatatatatatttttgtgtgtggagatggggtttcaccatgttgcccaggctggtctcaaacttagtttttccttgtaatttggggcatggcagttgcactcagtggtaaaccctgaaagctttcccacttagaaaaaattgttccatttttaaatagttaataaaggtgtgtttctaaacatagagataacactggaaaatttgaaactgtaatttcattccttgagagggttctaacttcctttactagcagctgtgaaccatgtaggatgtgagaaattacaccctaatcatctatttcctagccatgaacagttcaacctcggaaaattctaagcccaggctcattagtagccagtaaaatctggatgttatgtgagtcatgaataagaccagagtagaatgaacaagtaaaggtttactgtgtatgtatgaagatagggtagaaatatatcggttttatttttattttttgagacagggtgtcactctctcgcccaggctggagtgcagtggtgtagtcaggtctcattgcaaccttgaccctcccaggctcagcccccggagcagctgggactgcaggcgcatgccgccattcccgacagttttttgttttttgttttttgtttttctttttttggtacaggtggggttttgccatgttgcccaggctggtctcaaactcttgccatcctcccaccttggactcccagaggtttaggactacaggtgtgagccaccatgcccaacccatttgcaacttacaatccattgtaagttgaggagccatctgtattgtaaatctaatagttggtgccaggaactaagtggtcaggtgtaagtactgttttgttttgaaaagctgttacagttagtgatacacttgagagtggtgaggaagcccaccacacccgtcattttcctgccttaagatacgcagtacatcataactgtgtgtccgtcagagcttagtttacttgtacactgattttcagcagggactatctgaggaaggggaagatggcacttgcataacttggaaatgcctgcagttgattctgatgtgcctgtatgttagatggtagtgattacaggatctgtttcctaaggcttttggtgggaatgagctagcagtcggcacttagggctcaataaaaattagttaaagcaaattgctaccccctccatcccccactccctacacaatatggatttgtgagtacttttatccttgtctggcccataatagatactcaatacatatatatatgtattcatttttattaatttttttttttttgagacggagtttcattcttgtccaagctggagtgcagtgacgtgatcttggctcactgcaacctccacctcccgggttcaagcgattctcctgccttggcctcccgagtagctgggattacaggtgtatgccacacccagctaattgttttgtattttcagtagagacagggttttgccatgttggccgggttggtcttgaactcccgaactcaaatgatccccccgcttccgcctcccaaagtgttgggattacaggtgtgagccaccgtgcctggctgatactcaatacatattgataggattgagttggagtagttacatagcagatggagacacatttgttgaatacgccaggagttctttaactgacactaaacaaattattctcccatttcctcccataaactcctcaacaatcctctcaggtagatggtatatcatttccacaatttcagtggaataagtgcaggcacagcttgtaataagccaggagttaaacctaggagtcagctcagttccaggctctgagaagtaccccatgcagtcacctccttcttagggtggcctgtgaacttgatactctcagtactacctggcttcctctgaaaactgagtaatttttccttaccttatccttaaacttttcttgaaaatggaaaagcaaaaaaaagttaatctgtattgtgttgaagtacagtttctgcctccttccaaaccaggttcaaatgcgtttcccccctgtttgttaatgtcctgctcatcccacagcttggggtcatcttagaccttttactctccctttctcccaactcctgtcaggtgtagcccccatcccctcctagttgtattgcttggttgtctccatggcatgctttcttgcagtggtgatgtgggtcttcctgcctgtggggtcttgcccactctagttcatgtagtttaagctgcaagaaaaagatcttcctaagtgacagtctgagcctgtcacttaaaaaaaaaaagaaaacaatttggttgtcctttacctatcagggacaggaaattactttactcaacatttgatgctattgaaggttgggcccaaaacactttctcttgactcttacaggtattgatcctttccgggcaatgattttacaggttacaaattcattattttttcatacttgctgtgcatgattcatatgatttaattctttagtatcgttttctgtcgtggagattctttaaagcaggggcacgttcatattggagtataatttaggtttgtctgtatctgacaaactaaaatccaaaaagcagacttagatatttggttattagtatgtatttctcctacatctcttccagtaatgtcataagtaaatttgcagtgtggcaactggaaactggattgttgcttggttttagagttctagtataggaaaaaactggcatcattggaatcaccttttctgcagatatttttaatggcttatatatgtttcaggactttatacacatgtcatttatcttataggtatctaatttattcagggattttgataacatgagtatggaatattaaaaagggctaatcacaggctggatgcggtggctcaagcctgtaatcccagcactttgggaggccgaggtgggcagaacacctgaggtcgtagttcaaaaccagcctgaccaacgtggcgaaaccccatctctactaaaaatacaaaattagccgggcatggtggcatgcacctgtgatcccaggtactcaggaggctgaggcaggagaatcgcttgaaccggggagatggaggttgcggtaagccaagatcgtgccattgcactccaactccagcctgggcaacaagagtgaaactcagtctcaaaaaaaaaaaaaaaaaaaaagggctaatcacagctttcttgggctgggttacctagagagaatcacgggaagtagatgtgtatttgttgagcacatctctaatttgatctgtgctgagctgcaaattactttgacagtatctgtgaagaaaaggtttataaagcaaatcaaaagaataagcatgtttttatgaatacattgaaactactgaaaatgtttcaaaattggctgtaattagtagaattttgaaaagtaggttaagcagagacttctaacttgaaggcctgagttagctgccattgatctggggttattgattgaggcttgtgtcgtgttattgaacttctgtttttactgcatattaaaagataagtgaaatggatggataagtatcaatttttaatagaacttctttctgttaaacagcacctgtggaatcctctcaagaggaacagtcattgtgtgaaggtaatgatgtactctttgaaagtctacttgagaaaacattaggttgtctatatggtgtgtaaagctagatactgtttggtaaatatatattatatttcaatctcttgtctaggttcaaattcagctgttagcatggaactttcagaacctattggtaagaaaatttctgaccatattaatacagtaatatgaaactctttcactctcaagatttaaggtgcattatgtaagttacgattattgtaatgcctacatttaagacacattgagtctttgctattagtatttagaaagtagaacaaactaggcactaacactgccttgataaacttaatgattgcaaataaaattgagtggaggaatggtcaagtcaatttaaatacctgtacctgttctgttttctttttttgagacggagtcttgctctgtcgcccaggctggagtgtagtggtgcaatcttgggtcactgcaacctccgcctcccaggttcaagcgcttctcctgcctcagcttcttgagtagctgggattacaggcgcacaccaccacaactggcaaatttttgtatttttagtagaggcggggtttcaccatgttgatcaggatggtctcgaactcctgacctcgtgatccacccacctcggcctccgaaagtgctgggattacaggtgtgagccaccatgctcggccacacgttctgttttcttggtgaaaaatgttcttcctttttataactttattcttaagggtttcacgttctcagcgtgattaaagttgatgccaaagttttattagtttaagaggaaaaagaaaatatttcctaaatcctttcatatttctcgtgtgtcacgattttaaactttcctttttttcttactatcagggtgtctcaacactggaataactaggctgttgggaatgttagaactcttgtttgcattttgtttgccattatgaaaatgaagctttgctaaaatagcaatctcagcctgtgagtcagtgccctctgatgtgataccagcagtgagtctgccttgaaagctgtcacccatttctgctatgaaagaggttttcctgcttatgtgtcactaggcattaggaaatggaactacatatgcaaacttccatttgttgttttaaagctagtgtattttaaagtatagattgtaagtctttttcagaatactaagttaaaatgtctttcttcagtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaaggaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcctatccccagaattgtgagaaaaaaaatacagaattatgtgtctttcatttcagctatctctgccttccccccagatatgaaacactgtaccccttcttttagtagcaagaactcttttgaaagtgtaaaggagcggctgggcactgtggctggcgcctgtaatcccagcactttgggaggccaaggcgggcacatcacgaggtcaggagttcaagaccagcctggccaacatggtgaaaccccgtctctactaaaaatacaaaaattagccaggtgtggtggcatgagcctgtaatcccagctactccggaggctgaggcaggagaattgcttgaacccagaaggtggaggttgcagtgaggtgagatcgcaccactgcactccagctctgggcaacggagcaagattccgtctcgtggggaaaaaaaggtgtaaaggagcacatacctcatttgctgtaagtgaaaggaaaagcacctgaatctagttcacagttcttcagctgcttttgctcttggaaacttctcttggggaatttatagtctgttgccgctgtgctttcggagtaatctgttaaaaaattctttatcagtaaagtgtttttaagtggtttttttttttttttttgagatggagtttcactcttgtcgcccaggctggagtgcaatggcgtgatttcagcttagtgcaacctctgcttcccgagttcacgcgattctcctgcctcagcttcccaagtagctgggattacaggcggccgccaccacgcctagctaatttttgtatttttagtagaaacggggtttcaccatgttggccaggctggtctcgaactcctgacctgaggtcatccgccctcgctggcctcccaaagtgctggaattacaggcgtgagccaccgagcccagccttgaggctcattttcaaaaggagaagggtaatgaactaggatttatgccccaaattcatatggaagatttaattatgtatgttaaagggtgctgttgtttgcatatttagccattggtttttggttttaacctatggtttgcatgttgatgttacttttagatgctggcaagtcaaccattggaggacaaataatgtaagtctgtatcttttgttaaataacagagttaaattgatgtaatgaattttaggcattgtaaaccttcatacagtcacacaaaggagataaaacaggtcccccaaagaaaaattaaaaataaaattactgggacacaatactgatgttaagaagtgatttttggcctggtgtggtggaacacacctataatcccagcattttgagaggctaaggtgggaggatcactggacttgaggtctggagtttgaaaccagcctgggcaagacaatgagactctgtctctactttaatttttttaaaagtagtagtttttgtaatgtgattattactagtgttaaatgtgtttctgaaagctttttacattttttaaaaataaaaaatgaacacagaactctagattatgggaaacttggtctcctttgcatataacatacatgggaataatgacaaccagctcttgaatctggtgaatgggggaactgttttttcctcattcatcagctccttaaatgtatatggatttaataaaagacaggtagactagctaaaatgctaagataattttttgatcgtattatagaaatttcctaggtatgaaatgaccgtggctggcctttagtaatgcattttagtattgacaaatcttgataactaaaaagtcctaaatttttaattgcttctctaaattagacccatttctttgaactgtgtcatcagaggacctagagggcttgccatcatcttgcctagttaaattttttttttttttttttttttttttttttttttttttttgagatagggtctcattctgtcaccaaggctggagtgcagtggcatgattttggctcactgcagcctcgacctcctggactcaagcaatccttccacctcagcctcccaagcaggtgggatcacaggtgcatgcaaccaagcctggctaatttttgtgtttttttgtagaggtggtgtttcatcatattgcccaggctggtcttgacctcttggggtcaagtggtctgcccacctctactgcctcccaaagtgctggcatacaggtgtgattaaccacacctggctaatcatcattggtaatcttgccagttacttttgaacatttccacaacagagactctaagacaggctgttaaacaggggtccttccccaggtctctgtggttgaagtgtcacagccatatgatgttatgtttcaggacagtgtatattttttgctgatgggctgtaagttttggtggcgtcacactgggtttctacatgcaaatgcttaggtgcactgcactatagatgtctacgtggagaacacagatgaaagctatagggaaaggagagctttgaattggattgagtcaaggaagtatgcattactaacgaactattttgaaattattatctcattttgacaagtaataagacttacttgcctagacaacattgttgcaatttttttttcttttctatagtacctacatttacatttacttgttattttatttttaaatttacttggctgggcatggtggctcatatctgtaatcctagcattttgggaggccaaggcggaaggatcatttgagcccaggcttcaagaagagccaggacaatatagtgagaccctcatttctataaaaaataaaaataaaactatatttattttaagagacagggtctcgctgtgttgcccaggccggagggtagtggctatttataggggggaggatgatagcgcactatagcttcaaattcctgtgctcaactgatcctcctacctcagcctcccaagtagctgggactacacgcttgcaccaccatgcccaccttatatttacttaaaaaaaacaaacaaaaacaaaaaacaaaacctactatattctgaaataattttagatttacggaatggttgcaaaaacagtacgggaagttcccttcattcatcctgccctgatgttgacatcttataaccatagtcattcatcaaaacttccttattactggtgaaattagtcatgattacttggttaaggtgtcatctgtcaagattgtccactataaggttattgttttcccttttcttttcttttttttttttttttttttttttttgagacagaatctctatcgcccaggctggagtgcagtgcagtggtgtgatcttggctcactgcaacctccgcctcctgggttcaaatgattctcctgcctcagcctcccaagtagctgggattacaggcatgcaccaccacgtctggctaatttttttgtatttttagtagagatgaggtttcaccatgttggtcaggctggtcttgaactcctgaccttgtgatccgcctgctttggcctcgcaaagtgctgggattataggcctgagccaccgtgcccggccattttttattttttgttttttttgttttttttgtttttttgagaaagggtctccctgttgtttaggctggagggcagttgtgtaatcatggctcactgcagcctcaacctcatggactcaggcagtcctcccaactcagcttcccaaagtgctgagattacaggcatgagccatcacacctggcctgattttttgttttttttagagacagggtcttgctcttaaacacaggctagagtgcagtggtggaatcatagcttactgtaacctcacactcctgggctcaggtgatcctctcacttcagcctcccaagtagctaggaatacaggcatgcatcaccacaccaggccaattttttaatatttatgtggagatggtctcactgtgttgcactggctggtctcaaactcctggcctcaagggatcctcccacctcagcctcccaaagtgctgggattacgggcatgagccatcacaccaggccactttgtctgttaattcgagactgtaaatatcctttttccacttacactttccataattttagcatccaccagtggttcctttactttaactattttctggccaggcgtggtggttctcatgccagtattcccagcactttgggaggctgaggctggcagatcacttgaggtcaggagttcgagaccagcctgaccatggtgaaacccagtctctactaaaaatacaaaaacttagccaggcatggtggcacacgcctgtaatcccagctacttgagaggctgagacaggagaatcgcttgaacccaggaggaggaagttgcagtgagctgagatcacgccactgcactccaccctaggcgacagagcgagaccctgtctcaaaaaaaaaaaaaaaatatggccaggcgtggtggctcacgcctgtaatcccagcactttgggaggctgcggcaggtggatcacccaaggtcaggagttcgagaccagcctggccaacgtaatgaaaccccatctttactacaagtacaaaaattagccgggtttggtggtgggtgcctgtaatcccagctactcaggaggctgaggcaggagaatcacttgaacccaggaggcagaggttgcagtgagccgagattgtgccattgcactccaggtggatgacaagagcgaaactctgtctcaaaaaaaaaaatatatatatatatgtaatatatatattttatataaaaatgtgtaatatattttatataaaaatatgttatatatgttatatatatattttatatttttttagacagacacacacatataaaataactattttctgacgttgaaattttcgacaattttcacgttttcctaattccactgagtaatttgtgagtaattgtttacttttttttttctttaaatgttttcaggtatttgactggaatggttgacaaaaggacgcttgaaaagtatgaaagagaagctaaagagaaaaacagagaaacttggtatagtaaacttttatgacacttataaattacttttaaggagacgatgcccacttagtgcttttggagcctgttaaaatataaattgttgaagtctaaaatcgtatcacaacaaaggaaatttcccctctcctcataatacacagtagatgagttcctaatgctttaataacttacacagagaaatttggaaacaatccatatatctggtgatagacttgttgaaaatactataaaccatccatttaattgggtgattttgcaaccactgaaaacttacatttacataatttatagtaaccatgaatagaacttgcgttgtggtggcagttggggggaagcaggaaacatccctgtacttaagatatgaccattatataaataaatgctggaaataaaatggaatggaattattgacagtggttgcctttgaatggtgagacagtcaacttttttgttttctaaccttgttacttttatttttaaaaagttagcaagccttacctcaatgggatattgacagtcatttttttaaaataaaattatattcctctaaaataagcgggagaaatgctagtcagtgttgttataaaaaattgaggacatgctgtgaagatgatgaggtaagctaaattaatgcccactattacggatggtttgaatttatatgaatttttgcctggcagtgtgatattgaagcaatttttagcaagtaaccattgctcccacatggtgcgttagtggctttcagttttcaaaaatatctgaggacagttattttttattttattaaaaagttttagtcctggcacagtggcttaagcctgtaatctcagcactttgggaggccaagacgggcggatcacgaggtcaggagatcgagaccatcctggctaacatggtgaaaccccgtctctactaaaaatacaaaaaattagctgggcaaggtggcaggcacctgtagtcccagctacttggaaggctgaggcaggagaatggcgtgaacccgggaggcggaggttgcagtgagccgagattgcaccactgcactccagcctgggcaacagagtgagacaccatgtcaaaaaaaaaaaaagaaaaaaggaaaacaacttttattgggccaggcgcggtgactcaagcctgtaatctcagcactttgggaggcaaggcaggcagatcacacctgaggtcaggagttcgagaccaccctggccaatatggtgaaaccctgtctctactaaaactacaaaaatggccgggcacagtgtctcacgcctgtaatcccagcgctttgggaggccgaggcaggcggatcacctgaggtcaggagttcgagaccagcctgaccaacatggagaaaccctgtctctactaaaaatacaaaattagctgggcatggtggcgcatgctctaatcccagctactcggggggctgaggcaggagaatcacttgaacctgggaggcggaggttgcggtgagccgagatggtgctgctgcactccagcctgggcaacaagagctaaactccatctcaaaaaatatatatacaaaaagtagccgggcgtggtggtgggcacctgtaatcccagctacttgggaggctgaggcaggagaatagctggaacctgggaagcagaggttgcagtgagccgagatggtgccactgcactccaacctggccagagcaagactcccatctccaaaaaaaaaaaaaaaaaaaaaaaaaaagaagaagaggggtgggggtgccgggcacgacctaggctctgttgcccaggctggagtgtagtggctccatctccactcactgcaagctccacctcctgggttcacaccattctcctgcttcagcctcccaagtagctgggactacaggcacccgccaccacgcctggctaattttttgtatttttagtagagacagggtttcaccgtgttagctacgatggtctcaatctcctgaccttgtgatctgcctgcctcagcctcctagaatgctgaaattacaggcgtgagccacagcatccatccaaaaaagttttattattaccctttaactctcaagacagccattatttgtgttgtattttgtgccatgtgagtataaaaatgaagtaataagggagctcattatcacttaacacacagtgatattggcatttgtagttagtctttctgtgtagtcaacttgccataaagttctagatggtataattgactgcgtttatataaaagctctaagggtttgaatcaaaataatacattctttcagttttattttatttatttatttttttgagacggagtctcactgtgtcaccaggctggagtgcagtggcgcgatctcagctcactgcaacctccgcctcctgggttcaagcgattctcctgcctcagcctcccgagtagctgggactacaggcgcccgccaccatgcccagctaatttttgtatttttagtagagatggggtctcaccatgttggccaggatggtctcaatctcttgacctcaggtgatccgcctgccttggcctcccaaagtgcttggattacaagcatgagccactgcacctagccctttttttttttttttgagagacagagtctccctctgttgcccagcctggagtgcgatggcacgatcttggctcactgcaacctctacctcccagcttcaagcgattgtcctgcctcagctttcgaaatagctgtgactacaggtgtgcaccactatgcccaacttttgtatttttagtagagatgaggtttcatcatattagccaggctagtctcgaactcctgacctcaggtgatctgccagcctcggcctcccaaagtgctgggattacaggcgtgagccactgcgcccagccctattctttcaatttctttgttttcttttgagacggagccttgctctgtcgcccaggctggagtgcaatggcacggtcttggctcgctgcaacctcctcctcccaggttcaagcgattctcctgcctcagtctcctaagtactacaggtgggctcctccacacccagctaatttttgtattttcggtagagacagggcttcaccatgttggtcaggctggtgtcgaacccctgaccttgtgatccgccgccttggcctcccaaagtgctcagattacagatgtgagccaccgcacccggctcaattttcatttcaccaatcttgttcgtgatttaggtgttgtgtgtcatccattatatctttaatggtgaagaatatcctaaaaactctgatgttcttaggaatattgttctttttttaaaaattatttcaggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaagaaagacatttccagtccatctgtatatttgttagtagccccgcttatatctttaaatttgaatttatcttctaaaagctcaaattcaggttgcagtgaaatataatgatgtacacggtcacagttttcatcatactaatctctcttcaagaaatcttcaaaatttgatttacttctgaaaatacgtttcaccttttctctcctgttgctattatctattaccatgtcagaacttagtctccattaaatgccaagcccaccgttaggcaccatgggtaaaaaatgaataggaaaccatctgtttcatacggtcttcagtcattttgcgcttttcacaatgtactggtagtagatcacaattttttttcctttgtagttacaatagctagaaagtaaatgttggaattttaaaatatgcaggtatactagattttgggaatgtgggggattggaagcatctagacattgtttgatttgtgacattcaaaagcaggtacgtcataactcgtttgcttctattttcttgcaaaaaaaaaaaaaaaaactcgtgatataactgaaaggaaagatgttttactgccataagggtatgcctgaaggcgaaggagtaaactgtttcctttcttggaattaggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagaggtgagcgtagatgtctggtattttatgttagtgggattaaggatggttttgttattgtacgactttttctctagggtttttctaaaccttaatctgtttacttaggaaactagagttcttggtttacattataattgagttattttggttacattataattgcagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacatgtaagtaactgttttttcctttttttaaaaaggaaaaggatgttattacttaaattacttataaagacatatgctgagtaacatgttaacatatgcttttgagcatatatctttataagtaatttaagaaaatattaaatgtaaccttggctttaaaaatactaagatctttgcccatttttaaactgggttgtcattttgttactgagtcctaagagttctttttaatactggctaccagtcccttatcagctacaatatgattatagcaagtattttctcccactttatggattgccttttttcacttctcgatggtgtcctttgaagcacaaaaggttttatttttgaagttttttacatttagatatgtatttgattttgagttaacttttgtgtaagatgtaaggtctatgtgtaggtttgttttgtttttgtatattaattgtttacacacaatttgttgaaaagactattcttttttcattgaattgatttggctccctctttgaaaatcaaatgaccataaatacgagtttattcttgaactccgtgtttcttttttttggtttgtttttttgaaacaggttttcactctgttaaccaggctggagtgcagtggcatgatctcggctcactgcaacctctgcctcccagctcaagagatcctcccacctcagcctcccaagtcgtagggactgtaggcacatgccaccgcacccggctgatttttgtatttttagtagagacagattcaccatgttgcccaggctggtgtcgaactcctgggctcaagagatgcacctgcctttcggcctcccaaagtgctgggattataggcatgagccactgcacgcagccaatactgtatgtttaaaggggaaattattttatagaatcttggtttcatagctggaaaagtccataaaaagtaatatagtcaatttattacatgtaggctatttgctataaaatatttctctaaattttaataagtttatgaggaagccttatactgagcagttttataatagttttctgtggaataagtgagatgaaatggataataaagtggttgaatgggaagaatacatgagtagaatgaaaatattattagaagctgtttatagtcatgtaacttaacattttgatatttatgttgacttcctttaatggctttgttgttatgttctcagtggattaccgtttattccatatctggataatttgccgaacttcaatagatcagttgatggaccaatcaggctgccaattgtggataagtacaaggtacccaaaatgttaaagaaattgggtttcctgggaggggaaatcattgttgtgcattttgtttctagttttgaaaactttttttcttttcttttctttcttgttttttttttgacagaatcttgcactctgtcccccaggctggagtgcagtggcgcgatctcagctcactgcaagctctgcctccttggttcaagtgattctcctgcctcagcctcctgagtagctaggactacaggctcccgccaccacgcccagctaattttttatatttttagtagagacggggtttcactgtgtcagccaggatggtctcgatctcctgaccttgtgatccacctgcctcggcctcccccaaggtgctgggattacaggcgtgagccaccgtacctggccttcttttttttttttttttttgagacggagtctcactctgtcacccaggctagagtgcagtggtgtgatgtcagctcactgcaacctctgcctcccaggttcaagagattctccagcctcagcctcctgagtagctgggactacaggcgtgtgccaccgcatccagctaattgttttttgtatttttagtagagaccggttttcaccatgttggccaggctggtctcgaactcctaacctcaggtgatccgcccgccttggcttcccaaagtgctgggcttacaggcatgagccaccatgcccggtccaaaaactttattaacaacataacattgatgtctttttcttaatggctttatattagtggtatagatagaccataatttattcaacaagtttagtttattttagctgtttcccgatgagccagggatcatatcttagtgataaactcatagatgtaactgctgggctcaaaggattttcttattaaagttgatgcatattggtaaatagcatcgcaaaaatactgtgctaacttctgtcaccactagcagcatgagtgttagttttaccacagcctcaccagcactggatgttcgtcttaaaaaaaataaacttccttgtttttaactggatttccaacttgaatttttaagttttgcggtatcaatgtatgtaatgttttcccctcctcaaatacattattctttaattagctccgttctaaatttctttaacaagtattgctttttccaattttatatatgaggaaacaggcctagagatcaggagaacctgaatttgtacaaacagttcagatcttccaacataaacttctgtgttgttttctgcacctttttttttttttttgagatggagtctcgctgtttcaccaggctggagtgcagtggcatgatctcggctcactgcaacctccgcctcctgggttcaagcgattctcatgcctcagccttccgagtagctgggattataggcaggtaccaccacacccagctaatttttgtatttttagtaaagacggggtttcaccatgttggccaggatgggctcgatttcctgatcttgtgatccacccgcttcggcctcccaaagtgctgggattacaggcgtgagccactgagcccagcctttttttttttttgagacagagtcttgctcttttacccaagctggagtcgagtggttcagtctcggctcactgtaacctctgcctcctgagttcaagcgattcttctgcttcagcctctggagtagctgggattacaggcattccaccgtgcctggcaattttttttttttttgtatttttagtagagatggggtttcgccatattggccaggctggtctccaactcctgacctcaggtggtccacccacctccacctcccaaagtgttgggattataggcttgagccaccacatccagcttgtgccattttctttttaaattataggcatactgaattattaatatgatcatacatatgcttatgacacaaattattatagagtatttgttactgagtttaagatgaacctaagccttctacttaagcaaatgattttcctttatgaataagcagtgtagaatttcactttgggctattgagctgttatacagcaccaagaagtctgaaactggattttattttacatttgatcaggatatgggcactgtggtcctgggaaagctggaatcaggatctatttgtaaaggccagcagcttgtgatgatgccaaacaaggtaagaatcggttatgctgtttcctatctatttattgattttttttctttttctttaagagatagggtcttcttctgtcaccgaggcaggagtacagtggcgcattcatagcttattgcagcctcaaactttcaagcaatcctgccacctgagcctcccaagtagctgggactataggcttgtgccactctgcctggctaattttttttttttttaaataaaaattgagatggggtctcactatgttgaccagactagtctctaactcctggcctcaaacaatcctcccatcttggcctcccaaagtgctaggattacgggcgtgagccatcatgcctggcctcctttgtgtcatttttgactgttcagttgctgagatttgcagataacctgaggcagggcttctctaacagctccaaagatgttgcttatgcaggaccacagacttgagtcatcagtaccttcagatggagattttgctagatttcagtgagaatttatttaccatgctaactccaggcagagtaaattagaaaaagaatccattatcaaatgtaatatttagacataattggcaccttacaaattgtattatctggtttcttgatgccttgtgcattggagatgagaatatatagtatcttctaaaatgtttacattttaaagcctactttttcctattatctttgcaacttggaggctaacatatgagtgaaaataattctcaggttgagttcttagttagttgttgctgctgttgttgttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttactaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagaggcagctggtgggtgggccatgcctgtaatcccagcactttgggaggccaaggtgggtggatcacgaggtcaggagttcgagaccagcttggccaacatagtgaaaccccgtctctactaaaaatacaaaaaattagccaagtgtgtcagcgggtgcctgtaatcctagctacccaggaggctgagacaggagaatcgcttgaacccgggaggcggaggttgcagtgagctgagatcacgccactgcacaccagcacaggcgacagtgcgagactccgtctcaaatatcaaataaaaaagaggccagacttttacaataaaaaattcatggggttggcaacctacggaatgagagaaaacatttgccaatcatgtatctaaatatggggttaatatctagaatatatgaagaactcctacaagtcaacagaaaacctgaacaacccaattcaaaaatgggcaaaggactgcaatagacatttttccagagaagatgtacaaacagccaaaaagtacatgaagaaatgcctagcactgctaactattagggaaataaaaatcaaatccacagggctggacatggtggcttatgcctataatccctgcactttcggaaaagctgaggcaggaggatcacttgagttttgagaccaggctgggtctctcactatgtgtgagatcccatctcaattaaaaacttttttttggaaagcagagtaacacgtgttggcaaggatgtggagaatttggaacccttgtgcactgttggtcatgtaaaattgtgccaagtgccgtgaaaaaatatagcagttcctcaaaaaattaaacatagatttcccacataatccagcaatactctttctgagtatatacccaaaagagtctcagatatctgtataaacatgttcatacatgtattattcacagtagccagaaggtggaagcaaccctggtgtccataaaggatgatggataaagaaagcgtgttacatacacgtaatagaatattgcacagccttaaaaaggaagttctgacacaggccacaacatgaatgaaccttgaggacattatgctatgtgaaataaaacagtcacaaaaagacaaataccgtatgattctacttaaatgaggtacctggaatagtcacatttgtcacctgaaagtaggatggtggttgccagggttcgggtgaacggggagtttcagttttgcaagataacaagatttcagagttctgaatattggttgtacaatattttaaatgtatttaatttaggtgtactattgaaatgtacacctaaaatggttatgatggtaaattttgttacatgtattttaccacagtaagtaattaatgggttaaattaaaaattggttattttttactttgatattttatgaaactgttctgagatacagattgttttttgttttttgttttgtttttttttttttttttgagacggagtctcgctctgtagcccaggctggagtgcagtggtgtgatctcggctcactgcgacctccacctcccaggtcccggttcaagcaatgctcctgcctcagcctcccaagtagctgggattacaggaacgtgccaccatgcccagctcatttttgtatttttaatggagacaggatttcaccgtgttggccaggctggtcttgaacttctgacctcgtgatccacctgccttggcctcccaaagtgctggggttacaggcgtgagccactgcgcccagccgatacagattgttttttaggtgagtgacttctaaactcttgtttctttcttttttttttgagacggagtctccttctgtggcccaggctggagtacagtggcgccatctcagctcactgcaacctccacctccagggttcaagcagttctctgcctcagcctcccgagtagctgggattacaggtgcctgccaccacgcctggctaatttttgtatttttagtcgagacagggtttcaccatcttggctaggctggccttgaactcctgaccttgtgatccacccaccttggcctcccaaagtgctgggattacaggtgtgagccactgtgcccggccttttttttattattattattattattttttattttttggagatggagtttcgctcttattgcccaggctggagtatagtggcacgatctcggctcactgcatcctctgcctcctgggttcaagcgattctcctgcccaagcctcctgagtagctgggattacaggtgcctgccaccacgccaagctaattgttttttttcttttgtatttttagtagagacagggtttcaccatgttggccaggctggtctcaaactcctgatctcaggtgatcacccgcctcggcctcccaaaatgctgaggcgtgagccactgcacctggcctgcatagcattattgatgtagtaaatgtcactgatggtaaatttcccgtgtatctcctctcaggtcacttgttcttttgcttcaccttgctgccacagccagcactggcagtactgaggagcaatactggcatcagaactggaggctccataactattttatttttacattaaaaactttttttttttttttttttaaagacagggtctcgctgtgtcactcaggctacagtgcggtagtgtgatcatagctcactgcagccttaaaacacctgggctcaagcagtcctcatgcctcagccttccaagtagcggggctaaaggcatgtggactacccagctccgtggactattttgttagaaacaaagagtttaggccgggcacagtggctcacgcctgtaatctgagcactttgggaggccaaggtgggtggatcacctgaggtcaggagtttgagaccagcctggccaacatggtgaaacctcgtctctactaaaaatacaaaaaattagccaggcatggtggtgggtgcctgtaatcccagctacttgggaggctgaggcaggagaatggcttgaacccaggaggcagaggttgcagtgagccaagatcgcaccactgcactccagcctgggcaacaagagcaaaactctgtctcaaaataaaaaaataacaatgctatgcagccatcatcactatctaattccagaccatttcattacaccaaaaggaaatgatgtattcattaaatagttgatagacttttaaagcttagttcaataatttttaagtagtgcataattccgatatttggagattgataggtaatagaagacaggtttattaaatccttcatagaattccataataataaaaattatatccataaaactgaaatccaaatattaaattgtgttttcgattttgaaaaggtaaaaaaaggcaaatgctagtgtatacagtgttctagttggaaatgattagaatgtgatatttaaaaggtgacacgttaatactttaattggcagttatacttctaggatatgatttttgctgatcatatctaggctaagattttatgtcatacaaacataagtgtttacagtcaaatcttgcaactctttattgagcagacagacattcagatcattttatgttgcgtaatgcagtgaatgtgtcagaaaacctccagtcttgttttcttttaaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccaggtaaacaaattattgttgttgtcatagtgggttttaatgtctaaatgaaattagaatatcagtgccttttgtcctgattatttgtgacatgccagttaacccatcttagtgtagagaaggggaatggaaatattataagccacttatatatcataaccacaataggcacctcatacaaggtcttcaagctggtacaagtgcttactggataaggagtattctttgtaagttcctttttatgtttgatctcctgatgatacattctacagtatctaatattcactttgaccagagcacagttactgtggaagtcatggtttatgtgctcattgacagcacatagctttccagacaagaaatcacacaggtttccctgttattaacaatctaacctccctgggagaatgacagagtaagtgactggtgtgaataacagaattttttaaagttcttttctaaggtatgacaactaatcaagttagattttgatgccagatgtaaggttgtttactttactggaccttggatattgagaaatggataaagctggataagtttacatctaggtagcttctgagcggtaaaaattagcttagttccttggggaatataaggaaagtcttcccagataagaaagttggcctgctgtcttttgttttgtttggagatggggtcttgctctgtcacccaggctggagtgcagtggcgcgatcttggctcactgcaacctccacctccgggattcaagcgattgtcctgcctcagcctcctgagtagctgggatttaggcgcccaccaccacgcctggctgattgttttgtatttttagtagagacagggtttcaccatgttgtccaggctggtcctgaactcctggcctcaggtgatccccccggcccccctgccgcctcggcctcccaaagtgctgagattacaggcgtgaaccactgcgcccagccagcctgccgtattttgaaagttgaccagggacttgccaagaagataaatacaggataagatactgaaattcatgctttgagttcaagcagcctgacccatcctgtgaacaaaattagtaagacaaacctatcacctctaacacaaaaatcacttaagttgatgtcctagtgagatggtaacactaattcttgggatttatatggcgcttgagaacattgaattcttatttaccctaaggctaaagataagaatgtgtgtgtttgtttgacagatagtgattatagagcacaaatccatcatctgcccaggctataatgcggtgctgcatattcatacctgtattgaggaggtggaaataacagtgagtttaagataattggtttatttctgttttaatactgttttatcttcataatttctaatcagcaacagtgatgcacttttatttctacacctgttcttaaagattattttatttggcattattctgattttctcatactcttttcttggttaggccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagagcttttaaactgacgtctagtagtatatccaggatacctagctttggtcatcttcatcatctcagtacagtacacattgcaacaggttcacagaaaacttcgattcacattcttattcgtatgagtgttttatgagttgaatgtattgaacagaattgaccacgtgctttagtagtaatgccaaatctagtaatgctctacgtgaagaatcttaattttgatgttttgtgagtagtggatttggagggctattttgtttactaagatatttctatgatgtaatcctttgtaatatgtctagcgattaaaaggaacatagagattgatttttttttttacacctaatttttcagaggtctaatctttgtgaccttttgtgtgcatccatttctgcctacctctgggtgacgcagaacaactaacattcccatcttggggtcatgaagttctttggcataaaaacaaaatgattgttatgaaacgtttccttatgagcttttaatattcctgtccttttcctttccctttccctttccctttcctcttccctttcctttcctttttttgagatggagtctcgatctgtcacccaggctggagtgcagtggcaccatcttggctcactgcaagctccacctcccaggttcacgccattctcctgcctcagcctcccgagtagctgggactataggtgctgccaccatgcctggctaattttttgtatttttgtagagacggggtttcaccacgttagccaggatggtcttgatctcctgacctcgtgatccgcccgccttggcctcccaaagtgctgggattacaggcgtgagccaccgtgcccggcccagctgttaatatttctaacttagataaccattttaagactatagaagactttacataaaactttatagttccattgaaatacagaatagtcatttcacatgttcattccaattccatttagcaaaaactactttgtatctacaaagtgtcaggaactgtgctaagccctggtgatgaatacagttcctgaactttacattggatgaaattgtataaagacagtgtttattttactttaaaggcccagaactcttctggttgatagtaaaactggttattgggtttatcttattaatataacaaaatgatagttttagtttaccactcagaacctgataaaatcaggaagacagaagaaaagcaattaatgtagcaggaattcttaaccctagaattattttttcctaaaagctaacttggctttaaaaaaaaaaaaaaaaaaaaaaaaaaaaaagctaacttggcttttaggttttccacaagacccaatgggttttgtatcctttcagtccacaggattactaccagaaggacgtgttcactgcactgtagtcagtggtgattgctgtgccttttcacagttacttaaggataggttttgggatttttttttttagcagctttattgagatacaatttccataatatgaaattgacctgttttaagtatgtaattcaatgaattttagtatgtttacagaattgtacaaccatcaccatatactaatattagaacatttagaacacctaaaaagaaaccttacacctgttcataatcaccccttattcccacctccaccccaggcaaccatttttcaatttgtcttttatagacactccataaatagaattataaattatgtggtcctttgtctagtttattttacttagtgtgattttgaggttcaaccatgtaacatgttatttattcctttgtatcactgaatagtactccactgggtggatattccacaaatacggatattcccttttcttatttttaatccaaagaggttttttggcccagtgtggtggctcacccctgtaatcccagcactttgggaggccgaggcaggcggatcacctgaggccaagagttcaagaccagcctggccaacatggtgaaaccctgcctctactaaaaatataaaaattagaatgggcatggtggcaagcacctatactcccagctactcaggaggctgaggcaggagaatcacttgaacccagaaggaggaggttgcagtcagctgaagtcgcaccactgcactccagcctgggtgacagagtaagactctgtctttatgcagtggctcatgcctgtaatcccagcactttgggaggctgaggcgggtggatcacctgaggtcaggagttcaagaccagcctggccaacatggtgaaatcccgtctcaactaaaaatacaaaaattagctgggcgtggtggcaggcatctgtatctcagctactggggaggatgaggcaggagaattgtttggggggtacggggggagataggtttttgatacagggaaccatctctttaccagcccccccaaataagaccctcttattaagactacctaaatagaagtatcatgggtttggcagtaaagctagttaattagtaacttacattgtaaaaaatatttttgtgatttaaaataataagttttaatatcttatatagacttgctgttaactactgaaagatttttttaaaatttcatttctaggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtatacgacaac

SEQ ID NO: 8744 - DNA, 855 bp, Homo sapiens
ttatccttaaacttttcttgaaaatggaaaagcaaaaaaaagttaatctgtattgtgttgaagtacagtttctgcctccttccaaaccaggttcaaatgcgtttcccccctgtttgttaatgtcctgctcatcccacagcttggggtcatcttagaccttttactctccctttctcccaactcctgtcaggtgtagcccccatcccctcctagttgtattgcttggttgtctccatggcatgctttcttgcagtggtgatgtgggtcttcctgcctgtggggtcttgcccactctagttcatgtagtttaagctgcaagaaaaagatcttcctaagtgacagtctgagcctgtcacttaaaaaaaaaaagaaaacaatttggttgtcctttacctatcagggacaggaaattactttactcaacatttgatgctattgaaggttgggcccaaaacactttctcttgactcttacaggtattgatcctttccgggcaatgattttacaggttacaaattcattattttttcatacttgctgtgcatgattcatatgatttaattctttagtatcgttttctgtcgtggagattctttaaagcaggggcacgttcatattggagtataatttaggtttgtctgtatctgacaaactaaaatccaaaaagcagacttagatatttggttattagtatgtatttctcctacatctcttccagtaatgtcataagtaaatttgcagtgtggcaactggaaactggattgttgcttggttttagagttctagtataggaaaaaactggcatcattggaatcaccttttctgcagatatttttaatggcttatatatgtttc

SEQ ID NO: 8745 - DNA, 177 bp, Homo sapiens
tactaaaaatacaaaattagccgggcatggtggcatgcacctgtgatcccaggtactcaggaggctgaggcaggagaatcgcttgaaccggggagatggaggttgcggtaagccaagatcgtgccattgcactccaactccagcctgggcaacaagagtgaaactcagtctcaaaaa

SEQ ID NO: 8746 - DNA, 729 bp, Homo sapiens
gttgattctgatgtgcctgtatgttagatggtagtgattacaggatctgtttcctaaggcttttggtgggaatgagctagcagtcggcacttagggctcaataaaaattagttaaagcaaattgctaccccctccatcccccactccctacacaatatggatttgtgagtacttttatccttgtctggcccataatagatactcaatacatatatatatgtattcatttttattaattttttttttttttgagacggagtttcattcttgtccaagctggagtgcagtgacgtgatcttggctcactgcaacctccacctcccgggttcaagcgattctcctgccttggcctcccgagtagctgggattacaggtgtatgccacacccagctaattgttttgtattttcagtagagacagggttttgccatgttggccgggttggtcttgaactcccgaactcaaatgatccccccgcttccgcctcccaaagtgttgggattacaggtgtgagccaccgtgcctggctgatactcaatacatattgataggattgagttggagtagttacatagcagatggagacacatttgttgaatacgccaggagttctttaactgacactaaacaaattattctcccatttcctcccataaactcctcaacaatcctctcaggtagatggtatatcatttccacaatttcagtggaataagtgcatgcacagct

SEQ ID NO: 8747 - DNA, 530 bp, Homo sapiens
aaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgag

SEQ ID NO: 8748 - DNA, 15342 bp, Homo sapiens
gtgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctccccttcccctcccttgttccttccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggctttcccggacgcccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagcct

SEQ ID NO: 8749 - DNA, 914 bp, Homo sapiens
gtgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacctagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattct

SEQ ID NO: 8750 - DNA, 101 bp, Homo sapiens
tgaggcaggagaatggcttgaacctgggaggtggagcttgcagtgagccgagatcgtgccactgcactccagcctgggtgacagagtgagactccatctca

SEQ ID NO: 8751 - DNA, 761 bp, Homo sapiens
acagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatac

SEQ ID NO: 8752 - DNA, 1980 bp, Homo sapiens
tggaaatcatattacatagaatatttgggtgacatctgcctgagagatctccaagaattacagaaaaaaaaatactaatgcacttgagaaagcggtagttttgtggggaggcggaaaaagcaactgcttttctgcaacttggctggatgctaagatgtccgtggacatgaatagccaggggtctgacagcaatgaaaagcactatgactcaaattgtgaggaagaggaacaagaagaggatgaagaccctggggacatagaggactattacctgggagtagccagcaatgtggagcagcagggggctgatgcctttgatcctgaggagtactagttcacttacttgacctacaagaaatctgagggtgccctgaaagagcacatgaccagcttagcctctgtcctaaaggtatctcattcagttgctaaacttatattagttaatttccattggcaagtttcagagagattggacagatacaagtccaattctgctcaactgctcgttgaggctcgagttcagcctaatccatcaaaacatgttcccgcatctcatccccctcacctctgtgcagtgtgtatgcagtttgcgcgaaagaaaaacctactctccctggtctgtcagcaccagttttgccgtagctgctgggagcagcactgctcagttctcgttaaggatggtgtgggtgtgggagtcgcttgcatggctcaggactgtcccactccatacaccagaggactttgtgtttccattgcttcccaatgaagaattgagggagaaatacaggtgctacctcttcagggactatgtgaagagtcattactagctccagctgtgccctggtgcagactgcctcatggttgttcgggtacaggagcctagagctcaccgagtatagtgcaatcggtgcaacgaggtcttctgtttcaagtgtcatcaaatatatcacgcacccacagaccgcatcaccatccgaaaatggctcaagaagtgtgcagacaactctgaaacagccgactacagtagtgctcacactaaagactgtcccgaatacaacatctgcattgagaagaatggaggctgcaatcacatgcaatgctccaaatgtaaacacgacttctgctggacatatctaggagattggaaggcacatggcagtgaataatatgagtgcagtacttacaaggagaatcctgacattgtgaaccagcgccaacaagcccaggcgagggaagccctcaaaaagtacttattctactttgagaggtgggaaaaccacaacaaaagcttgcagctagaggcacagacataccagcagattcatgagaagattcaggagagggtcatgaacaatctggggacatggattgactggcagtacctacagaatgcagccaagctcttggccaggtgttgatacaccctgcagtacatcaacccatatacatattacatggagtctggacccaggaatgagctgtttgaataccagcaggctgagcaggaggctgaaattgaaaacctctcatggaaagtggagcatgcagacagctatgacagaggggacttggagaaccagatgcatgtagccgagcagtggaggagaaccctgctgaaggatttccatgacacctaagttgggatgtggatgtgcgggggtgaggaagataaggctgcaaggtctcctggctgccctactacatgctgcaggctctgcctttcatgacccctggcgacagccagggccccactcctgagagacactggcaacacctcatagttaatttctgttttcttctcttctcactttttgtttctgccagggtagaggccatgttgaactggtctcttttcaggacttttacttccccctggatggttgttgagagggagggaaagtgttttttggatagctattaataatattagatcattacaacttatgtaactttcaaagtttgtacaattatacaaaaaaa

SEQ ID NO: 8753 - DNA, 1981 bp, Homo sapiens
tggaaatcatattacatagaatatttgggtgacatctgcctgagagatctccaagaattacagaaaacaaaaatactaatgcacttgagaaagcggtagttttgtggggaggcggaaaaagcaactgcttttctgcaacttggctggatgctaagatgtccgtggacatgaatagccaggggtctgacagcaatgaaaagcactatgactcaaattgtgaggaagaggaacaagaagaggatgaagaccctggggacatagaggactattacctgggagtagccagcaatgtggagcagcagggggctgatgcctttgatcctgaggagtactagttcacttacttgacctacaagaaatctgagggtgccctgaacgagcacatgaccagcttagcctctgtcctaaaggtatctcattcagttgctaaacttatattagttaatttccattggcaagtttcagagagattggacagatacaagtccaattctgctcaactgctcgttgaggctcgagttcagcctaatccatcaaaacatgttcccgcatctcatccccctcacctctgtgcagtgtgtatgcagtttgcgcgaaagaaaaacctactctccctggtctgtcagcaccagttttgccgtagctgcttggagcagcactgctcagttctcgttaaggatggtgtgggtgtgggagtcgcttgcatggctcaggactgtcccactccatacaccagaggactttgtgtttccattgcttcccaatgaagaattgagagagaaatacaggtgctacctcttcagggactatgtgaagagtcattactagctccagctgtgccctggtgcagactgcctcatggttgttcgggtacaggagcctagagctcaccgagtatagtgcaatcggtgcaacgaggtcttctgtttcaagtgtcatcaaatatatcacgcacccacagaccgcatcaccatccgaaaatggctcaagaagtgtgcagacaactctgaaacagccgactacagtagtgctcacactaaagactgtcccgaatacaacatctgcattgagaagaatggaggctgcaatcacatgcaatgctccaaatgtaaacacgacttctgctggacatatctaggagattggaaggcacatggcagtgaataatatgagtgcagtacttacaaggagaatcctgacattgtgaaccagcgccaacaagcccaggcgagggaagccctcaaaaagtacttattctactttgagaggtgggaaaaccacaacaaaagcttgcagctagaggcacagacataccagcagattcatgagaagattcaggagagggtcatgaacaatctggggacatggattgactggcagtacctacagagtgcagccaagctcttggccaggtgttgatacaccctgcagtacatcaacccatatacatattacatggagtctggacccaggaatgagctgtttgaataccagcaggctgagcaggaggctgaaattgaaaacctctcatggaaagtggaacatgcagacagctatgacagaggggacttggagaaccagatgcatgtagccgagcagtggaggagaaccctgctgaaggatttccatgacacctaagttgggatgtggatgtgcgggggtgaggaagataaggctgcaaggtctcctggctgccctactacatgctgcaggctctgcctttcatgacccctggcgacagccagggccccactcctgagagacactggcaacacctcttagttaatttctgttttcttctcttctcactttttgtttctgccagggtagaggccatgttgaactggtctcttttcaggacttttacttccccctggatggttgttgagtgggagggaaagtgttttttggatagctattaataatattagatcattacaacttatgtaactttcaaagtttgtacaattatacaaaaaaa

SEQ ID NO: 8754 - DNA, 107 bp, Homo sapiens
actcacaatagcaaagacttggaaccaacccaaatgtccatcagtgatagactggtttaagaaaatgtgtcacctatacaccatggaatactatgcagccataaaaa

SEQ ID NO: 8755 - DNA, 711 bp, Homo sapiens
ttaaatagagaatatagcccaaaccttaatgtgctggaagataattacttagaatatccgacagctttgcgagaggcctgtattactttaaaaggtataaatgataggttgtgtaataccctacattcttatcttgaactatattatcgggggctctttctgttttaccttaatgtgcccaggggactcctgcttagcttaataggacacccaaaaggaggaaatgcagagttaatggtttaacaaattctaaactttattagcaatttgcatttaggagaagggcagatggtgtgtggtcgaaagctcatgggactgtgaattggtagactttttttaaaatccagcttttgcccctaacttttggtctcggagacctctgttctttaataactagaactgtaggccgggcgtggcggctcatgcctgtaatcccagcactttggtagggtgaggcgggcggatcacaaggtcaggagttcgagaccagcctggcccagcatagtgaaaccctgtctctagtaaaaatacaaaaattagccaggcatggtgacgtgcgcctgtagtctcagctacttggaaggctggggcaggagaattgcttgaacctgggagatggaggttgcagtgagcccagatcaccccgttgcactccagcctgggcgacagagaaaaacaaaaatccttctcaggaaaaaaaaaaaaaaatta

SEQ ID NO: 8756 - DNA, 637 bp, Homo sapiens
ttaaatagagaatatagcccaaaccttaatgtgctggaagataattacttagaatatccgacagctttgcgagaggcctgtattactttaaaaggtataaatgataggttgtgtaataccctacattcttatcttgaactatattatcgggggctctttctgttttaccttaatgtgcccaggggactcctgcttagcttaataggacacccaaaaggaggaaatgcagagttaatggtttaacaaattctaaactttattagcaatttgcatttaggagaagggcagatggtgtgtggtcgaaagctcatgggactgtgaattggtagactttttttaaaatccagcttttgcccctaacttttggtctcggagacctctgttctttaataactagaactgtaggccgggcgtggcggctcatgcctgtaatcccagcactttggtagggtgaggcgggcggatcacaaggtcaggagttcgagaccagcctggcccagcatagtgaaaccctgtctctagtaaaaatacaaaaattagccaggcatggtgacgtgcgcctgtagtcccagtgactcaggaggcggaggcaggagaattgcttgaacctgggaggcagaggtgcagtgagctgaga

SEQ ID NO: 8757 - DNA, 283 bp, Homo sapiens
ctgcctctgtcccctcgagagtaacatcagtgtgtctttcctagctgggagatcaggccaccaagagagacagtcattttgaaatgtgcgaatgttttcacaattgttcgagattatttctcagtaacacagctttagtctacagagcttgctaacctgcctcagtattctgtgttcttttattgtgggtagatagatgttgataaatcaaaagaaaaaaaaatcttgttaatttcagcattacatcagatcttagcaaatgtagatttctattataatattt

SEQ ID NO: 8758 - DNA, 255 bp, Homo sapiens
tctcgctctctcccccaggctggagtgcagcggcgcaatctcggctcactgcaagctccgcctcccgggttcacgctattctcctgcctcagcctcccgagtagctgggactacaggcacctgccaccacgcccactaattttattgtatttttagtacaggcggggtttcaccgtgttagccaggatggtcgcgatctcctgaccttgtgatccgcccgcctcagcctcccaaagtgctgggattacaggcgtg

SEQ ID NO: 8759 - DNA, 283 bp, Homo sapiens
ctgcctctgtcccctcgagagtaacatcagtgtgtctttcctagctgggagatcaggccaccaagagagacagtcattttgaaatgtgcgaatgttttcacaattgttcgagattatttctcagtaacacagctttagtctacagagcttgctaacctgcctcagtattctgtgttcttttattgtgggtagatttatgttgataaatcaaaagaaaaaaaaatcttgttaatttcatcattacatcagatcttagcaaatgtagatttctattataatattt

SEQ ID NO: 8760 - DNA, 497 bp, Homo sapiens
tggagatcccaggccagagtaaggtacctgaactcttcctcgcgcctccctgcacatgtgctcccccgcctctgtagaactgatgatggtcatcgtgtgtgtcattgtgcaaaaagcattgtccgtgccatcccctctccaagggacacttcttacccctatccttcaaggccttctgcaaatgccattctctccaggaaagcctttccgcattctcagttggatttgatcttctcttcgaactcccaggcccttttgttccctttgaggacagattgcattctgctttttaatctagctgtgttttatccccctcagtggatggaaggtgtcttcagggccagaactgtgggttcctcttccttctcatcagtagcatcgccatagctcctgatttctgaacacccactaaacaccaggcactgggctaggtactttgtcacaaaatttcactgaaacctcccttacagcaactcccaagaggtgggtggtgccgt

SEQ ID NO: 8761 - DNA, 497 bp, Homo sapiens
tggagatcccaggccagagtaaggtacctgaactcttcctcgcgcctccctgcacatgtgctcccccgcctctgtagaactgatgatggtcatcgtgtgtgtcattgtgcaaaaagcattgtccgtgccatcccctctccaagggacacttcttacccctatccttcaaggccttctgcaaatgccattctctccaggaaagcctttccgcattctcagttggatttgatcttctcttcgaactcccaggcccttttgttccctttgaggacagattgcattctgctttttaatctagctgtgttttatccccctcagtggatggaaggtgtcttcagggccagaactgtgggttcctcttccttctcatcagtagcatcgccatagctcctgatttctgaacacccactaaacaccaggcactgggctaggtactttgtcacaaaatttcactgaaacctcccttacaacaactcccaagaggtgggtggtgccgt

SEQ ID NO: 8762 - DNA, 497 bp, Homo sapiens; identical to SEQ ID NO: 8760

SEQ ID NO: 8763 - DNA, 387 bp, Homo sapiens
gaaaatggagacagcagaaaccctagggctcctattcaatatgaacgtcactcccacagtagcaacgggcgtacaagggactgtgcaccctttgcctgtttttgactgtctcctggtctggtaacataggataaccccatttttgttttactgtctccatggtttggtaagataagataaaccattttttagagaaggaaaactgaggctcagagaacttgtatttcatggaagggtctggggggaactcttcctccaaagggggcctctcctgccttcggcccctgtgccctgaggctgcggggaaggtgggcgttcatccttcctcagagccgcccctgatggacacatggcccatctgcccccatctgacatcttgaccgagga

SEQ ID NO: 8764 - DNA, 387 bp, Homo sapiens; identical to SEQ ID NO: 8763

SEQ ID NO: 8765 - DNA, 387 bp, Homo sapiens; identical to SEQ ID NO: 8763

SEQ ID NO: 8766 - DNA, 7720 bp, Homo sapiens
agcctaacatggcagaccagagacagcgctcactgtctacctctggggagtcattgtaccacgtccttgggttggacaagaacgcaacctcagatgacattaaaaagtcctatcggtaagtggacaagtgtggcccccacatccccccaggaagacacacatgccccgtgtggtttagtctgcattttaccaagaaccattgcacatactttatcctggccgactcagcgttgaactggtcacagctcggtaacacctttgtatgtgtaatgtactccttatagcttaaagttatggtattcatgttctcttgccaacaaaaaatagcacttagtagaaactgacacactgtccacagttccatagggagtcagggtctgaacctgtttgaggcctcacaggagccgcagagcgctggcatggtcctgtggtctccttgttttagcacagtgatgacagagacccctcactctgttgtggccttctgattgagcttgaagaactgcactcttgggtacagtttcattgagtaacctgtaagagacaccatcactaatccagacaattcagatagtcctcctctcgtgtgctagcatcgtgtagttcataaaacacttcttaaagtgccatcattacgccccgccgtgcttaccgttcacttggcacttgtgcagttagcggctgggacaccagggctggccttggtgccgctgaacttagatgtgccgtggcactcacagcccttggggctccctcctctgaggctgggtcagggtgaggaggtttacctgaaacaaccgcggagcttgcttttgtctctggcccctgcagccctggagagtcggacagtgaggtggcctgggtggacctgccttccactgcacccggcagtgcgtgcgggtgggatggacgcggcggcgggtgcgggtggaacaaagtccagggtagagccaggacatggttttggtttgcaggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggtgagggcgagctgcctgccgtgcgggcacccgagtcactcctgccgtgcgggcacccgagtctctcctgccgtgcgggcacccgagtcactcctgccgtgcgggcacccgagtctctcctgccgtgcgggcacccgagtctctcctgccgtgcgggcgcccgagtcactcctgccgtgcgggcgcccgagtcactcctgccgtgcgggcgcccgagtcactcctgccgtgcgggcacccgagtctctcctgccatgtgggcacccgggtcactccacgcctgcagggttcccagcattgcagagcccatgcgttgatgccagcaactctacactcctgagaaaaggcttctgggcatatggagcctttctcctcacctgtgtgatgggcgaagctctgtcactggcttggtgtcctgcctggaacaagccatagcgtacagattgtcccagggaagagccgtgcggagccgccagggtttcttctgtaaatggctcccagtccttcgtgagacaggaggaaataagcctcgatgttacatccgcatttcttcgtttcctcgttttgttccaaatgtcatatatgaggccagagggttggaatcactgcatggcatttgtgagaagcctgtatttggctttgactggtcggcctcctcactagaatccttataaagtactttttatttagttaatgttagacagagtctcgctctgttgcccagactggagtgctgtggtgagatcctggctcactttaactttgaattcctgggttcaagtgatcctcccacttcagctccagaactgcaggagttgaggcgtgaaccactgtgcccagcctggaggctgctttgttttttttttgagacggagtctcgctctgtttcccaggctggagtgcagtggcgcgatcttggctcactgcaagctccacctcccgggttcacgccattctcctgcctctgcctcccgagtggctgggactacaggtgcccgccaccacgtccagctaattttttgtatttttagtagagacagggtttcaccgtgttagccaggatggtctcgatctcctgacctcgtgatccgccagcctcggcctcctggagtgctgggatgacaggcatgggccaccacgcccgtcttggaggctgcttttctttaagctgcgggtttctttctgtctctcctcctcccttcttcagttctttccttctgcttcctgtctggaaggcagtatccccacctggaacgcaccccctgccttctgctgagggcatttgggagtcctgcgcctccctctccaggggcctcggaggccatgcaacaccaccttcttctccccccaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggtgagtgcccgccccagggcccgtgtgtgtgtgtggggcagagccagaatgggccctgaatggtgtcaacctgtcttgtcaaacaggagggcactgacactgtgccgcgagtgtttgtggtggcagctgggactgttgaggtgtgaacgtggaccctgaggtaaagcaggcgcatagagctgtccccgccgtgacctgcggtagccgtagatcccagggactgcgaggcggggcagggcggcaggcagttggggcggggctgagggccgagggctggcggtgacccaaggcgacggaggaaagccgtgtggggtggaggtcagcgagtagcctctcccggtggagagtttgtccaggtgcccgaaagtcgctccacaggaccagcgttgggtgcgcgccaggctgtggccctcgtgcagtgccctgtgtgcttgcttttcagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcctgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggacccca

SEQ ID NO: 8767 - DNA, 6746 bp, Homo sapiens
agccaggacatggttttggtttgcaggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggtgagggcgagctgcctgccgtgcgggcacccgagtcactcctgccgtgcgggcacccgagtctctcctgccgtgcgggcacccgagtcactcctgccgtgcgggcacccgagtctctcctgccgtgcgggcacccgagtctctcctgccgtgcgggcacccgagtcactcctgccgtgcgggcgcccgagtcactcctgccgtgcgggcacccgagtctctcctgccatgtgggcacccgggtcactccacgcctgcagggttcccagcattgcagagcccatgcgttgatgccagcaactctacactcctgagaaaaggcttctgggcatatggagcctttctcctcacctgtgtgatgggcgaagctctgtcactggcttggtgtcctgcctggaacaagccatagcgtacagattgtcccagggaagagccgtgcggagccgccagggtttcttctgtaaatggctcccagtccttcgtgagacaggaggaaataagcctcgatgttacatccgcatttcttcgtttcctcgttttgttccaaatgtcatatatgaggccagagggttggaatcactgcatggcatttgtgagaagcctgtatttggctttgactggtcggcctcctcactagaatccttataaagtactttttatttagttaatgttagacagagtctcgctctgttgcccagactggagtgctgtggtgagatcctggctcactttaactttgaattcctgggttcaagtgatcctcccacttcagctccagaactgcaggagttgaggcgtgaaccactgtgcccagcctggaggctgctttgttttttttttgagacggagtctcgctctgtttcccaggctggagtgcagtggcgcgatcttggctcactgcaagctccacctcccgggttcacgccattctcctgcctctgcctcccgagtggctgggactacaggtgcccgccaccacgtccagctaattttttgtatttttagtagagacagggtttcaccgtgttagccaggatggtctcgatctcctgacctcgtgatccgccagcctcggcctcctggagtgctgggatgacaggcatgggccaccacgcccgtcttggaggctgcttttctttaagctgcgggtttctttctgtctctcctcctcccttcttcagttctttccttctgcttcctgtctggaaggcagtatccccacctggaacgcaccccctgccttctgctgagggcatttgggagtcctgcgcctccctctccaggggcctcggaggccatgcaacaccaccttcttctccccccaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggtgagtgcccgccccagggcccgtgtgtgtgtgtggggcagagccagaatgggccctgaatggtgtcaacctgtcttgtcaaacaggagggcactgacactgtgccgcgagtgtttgtggtggcagctgggactgttgaggtgtgaacgtggaccctgaggtaaagcaggcgcatagagctgtccccgccgtgacctgcggtagccgtagatcccagggactgcgaggcggggcagggcggcaggcagttggggcggggctgagggccgagggctggcggtgacccaaggcgacggaggaaagccgtgtggggtggaggtcagcgagtagcctctcccggtggagagtttgtccaggtgcccgaaagtcgctccacaggaccagcgttgggtgcgcgccaggctgtggccctcgtgcagtgccctgtgtgcttgcttttcagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggacccca

SEQ ID NO: 8768 - DNA, 297 bp, Homo sapiens
tttgtttgttttttgagatggagtctcgctctgtcacccaggctggagtgcagtggcgcgatcttggctcactgcaacctccgcctcctgggttcacgccatttaggaaaacgcatgcctcaccctcccgagtagctgggactacaggcacccgccaccacgcccggctaattttttgtatttttagtggagatggggtttcaccgtgttagccaggatggtctcggatctcctgaccttgtgatctgcccacctcggcctcccaaagtgctgggattacaggcgtgagccaccgcg

SEQ ID NO: 8769 - DNA, 481 bp, Homo sapiens
tctgttccttatgatttccttgcttgcatttatgttgggtttatcctgttactttgtagcttcctgaggcggagccttaggccttgattaacgtgttgtactagtcagcattctgcagaggaacgttgccattatctgtgtctctttctaaaggagatttgttatgaggaattggcccacgtcattatggagacggaatctcatgctctgccatttgctgaagattgaggaaagcagtgggataataacagtccaaggacaggaggagacacgtggccccgctcaggctggcaggcgagaaggaaaacccaggccaactcctcctcccacccctttctattcgggacccccgtggactgggacgacactcacctgcacagggcagcgcagttggcttcatggagcccccagctcaggtgctgctcttaccaagaaacaccctcccaggcacaccctgaagtcatgtttcatctgggtgccc

SEQ ID NO: 8770 - DNA, 89 bp, Homo sapiens
ttttttttttttttgagatggagtctcgctctgtcacccaggctggagtgcagtggcgcgatcttggctcactgcaacctccgcctcct

SEQ ID NO: 8771 - DNA, 14471 bp, Homo sapiens
aatgtttggtgttttcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaagtttggtgtttatatttccagccttctacataacatatccgagttgtatatgtgtgaatagtacaaaaatagttttacataattcatagcaatacttcgtagagcttcatatcttgctttttttcctcttaatatgcattaaaaacatttccccaaggcatgtttttacaaagcatgctgttgcacagcttcatcttattgtgtaccataatttacttagtctttgtgatagttaaccgtttttctacgttttgcttttaaagcagtgagccaagaaaatctttgtacatacattgttttttcacagctctctgattatttcccgagtatgccaaaatgcttttgaaaggaggttttgcagtgcttggtactacccattagacatacaaatgctcattttcatcttttaccaacattgagtattatcattcttattaagtttttgttcgtttgataagtttgggtcatttattttattttgcatttatttgatttcaaataaggttgagtaatttttaatatgttatgctattggccatttatatttctaatgtaaattgctggtttgtgttcctggcctatttttctactagggtattttttttgtcataatgttctatgagagccttttttaaatgaaagatttttccatttgaatttctattagttctttgccttttaattttaattttacatttttacatagaaatttttgaaaaaaatcttctggtttcttccattacttctgtgtttgcaaagccttccctgtttcaagattagaaaacagttctagttccttccagctctttttttttctttttgaaataggatctcgctgtcttgccctggctggacataaatatggtttattttttgcctttaacattttcagatatttgaacctttttttgtgtgtgagctaagatctcaactcaatttttttcagaaatttagccaattttctcagaacaattaattgaatattctttccattaatttgaaatgctatttacatgctaaattgttatgagaagtttctggaatttctgttctgttgcgttgatatgtatgctgtttttattctagtcattttaagtaatggaagctttctattacattttaacttgtgctgatgttcctcctatacataggtcactgtggtcttcgtttgtttttcttggctgctggtgctcacttagtttctttggtgctttcaatttgaaaatatttcataaagatataagcatttagttgtatcttaaaggagccatcttatcaggtaaacattagtgtgatggattctgagattcataaagccctgaaacgaatgtttccattttgttcctttggcagcaggttgtccagagcgttgttcatctctacgagctcctcagcgctctgcaggtgcgtgccttcatcttccatccctgcgtttatttgtctagagaacagcagcttggggctgttgttgacttggatctttgaggtttgcaggatgtttaatggataaatggggccctcagtctagggaagactggctctcgtggtgagaaagttacagaatgcatcgaccttccaggactagaattagtgaagagctggtgtgccgtaggcatggcttgataaccatgctacaaatcacatagcatgctaacatgcatctgggagattacttcactttagaaagccttaagtatgattataagtttctatattccgtatctctgtggtatttgaatagagtggccttcctaatacagcttctgtttcggacttcccaggaacatcctcaaattctgctcacttcctttcttgaagatctaacctgtctcattcctactttctcccacttccaacacacacacacacaacccacccacccacacagacacacacacacacaaccacccccccccccaccccaggtaataccactgactgcaaacagcatgcaaccagattgacaaaaacccgtgagttcctgcacctttgaggttcttgtatgataaacagctgcaattatcctggagcatttttatgagacgggcttgaaaaatgaggggagagttctagtccgtcatagtgcctggtgccccctgctgtggggtcgggagggatccagaagctcgctgtcgtcctggccagagttgcagggctcccctctgtgtgcctcccagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaacggcaggcgcgagcgtgagtgggaagctcgtgagagggagctgcgggagcgggagccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtaatgggactccctgccgagagcaacctaatgatgatattaattaagaccccctgtgtattaagcaaggtaagaaagtgagcagaaatatagagcctgtttttggccagatgctcatgcctgtgatcccagcactttaggaggctgaggtgagagggtagcttgaccagcctgggcaacagagggagactctgtctctcctaaaaaaaaaaaaaaaaaacaaacaaacaaacaaacaaaaaaacagtttttaagaatctttgtagctggacacaatggctcacacctataaatcccagcaccttgggaggccgaggcaggtggatctcttgaggccaggagtttgagaccagcctggtcaacatggcgaaacggcgtctctactaaaaatacagaaattagctgggtgtggtggcaggcgcctataatcccagctgcttgggagtctgaggcatgagaatcgcttgaaccggggaggtggggattgcagcgagccgagatctcgccactgcactccagcctgagcaactccgtctcaaaaaaacacacacagaaaaacaaaaagaatctttgttttaccccgaaagagaggcagaggcagaaagtcttcttctgctttttgcatctctaagaggctgaaaaagagaatggaagtgctggggcattttggccagggcagtaatggatatttggagttggcacttccctcagctagaggagtctcagtgtgtctgagaaaatggcagtcagccatccaggattttaggagcaacgccactgctctgtgccacatcagaaatcaggcatggccccaacctgaaggaacttgtagcttaatggggaagcacaccaagaataaaagagcctccagaacatgtggtgcctgtggtcctgagacagcaggaaatggctctcaggccagagttgctggaagaacccatgtggcaggatcggtgggaggcagttacagagggaaacgcccatcccagcaactaggggaggccgccactcctctcgtggatggatgatattcttgcttggggatgttgagacagctgcactctgcatagttcctgatttgcctctctactgctgatgaaaaacctctctttctctatagctgctgcttatattggaaggcttttggttattcagcacactcactcctgagcttatttcagtgatattccttggttatttcgaaacatggatgcttgtggcagatggagagcctgggtgtacacagatctgcctgtgttttgaaatgcataccatgttgccgtttgtttgattgattgatcttggaccacgaaagaaaattatactgacagcttccagggtagggggcagttgtagctttctgcagatgttgccaaatatattgggggtggggagcagcaaatgccatgtgttgctttttatgacataaggagggattccacccccatcccaataaaatcggtgctttgacaaaggagggttcccaggcagctaagagaacccagagtagatgatcctctttatctctggtttaacctgtgactaggattcttggtgtaagctcggcttttccacttatcctctaaccggaacaggcttctataatctctttgccttaaaataattatctgcatccctgtgtagagcaatcttaagcagctctccttgtttcttcagggaatgggaattcttttctaagtcgccccatcaaaggtactattggttttttacaacgccggcgtttgtgtatgtagtaaaagtattaacagcattaaaggcgatatttttaacatgtttatagatactacttgggggagggcagctaatgaaaccttcaagctctatgcagtccacagacgtgagctctgtagagttcgcagaggtgggtaagtacccagccagcacacccagttgaattcagccaggatttattgagttggcatcacagacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtggtgagtcacgcacacctgctctccctgtggccatagtgtctgtgcattctgagagagggtagattttagtggcatggggcggggttgaaaaggggacagttcagatgctcaaaagccaaactgccatccttttcaccagctccgcttgctaagagcactcatgcagcgaacattaagaacccactctgtgtggcacgtgtgcagaagcagagagcatgggtttcattttcaaggcattatccgatcgaggaactggagctcacccctcaatgaagtaattcaagtcctccttgcctttctgggcctagagtagtcattggtaacagctagcatttggtgatttaaccctcaaatgactgtatgaagttggcactgctaaccccaagagaagtgaggaaactgaggctcacagaggctaactaatgtgccagcggccacagagcctgcggctgaattccactaaatgcctccctgttcatgtaccactttttcccctgaatccttctctttaggattgatctctcctttctgtgtgggaggttaaagaaaaagtacattttcctggcctcttcataaattctagtgattatttaaaagttaaagggagcattaggcagtgaaggatatcacttaagaaccttattaaccaaatttgttcagaaaccccggtgcgcagaagagttaattgcccataagccccagtcgcctgtttgcattacagaagactttgggatggggaggaagttcaatgaaaggagcagtttttctgaatttttttcattcttggttttcacatttccagatggtcccacgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgttttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaacaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagaggatgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcattttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgtcaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttccaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttctggttggtgctgtgacttattcctattcctgattcctgtagaagggatactccccatccacccccatagctcttgaggagacgccttatgcaccgagcagctgctggggacgcatttcactctcggagtgggacccaaacccagagagtgactgatcagccctaaagtcaaacaaacagtttatgccaagagccaaaacttcctatttccagataaatcaatacagtgaacaggaactttgctatagagcctgcgacttcccttaatgttagtttctctctcttcgctaacattctccaccccgtcccacccccaaactagagcaactgccagaaactaattcaagaagaaagatcctctctgcttgtagctcccggctgattcactgggtctgatcccggaatgtcggggctcccctggagacacacagggctccagctgtcactggctccaccagcacagcctgtgccttccatttttagattagattactagcttcctactcttccaggtctgcgctttctggacctataggaagacccttaagtccagctgggccttggagaactgtgccgctcgcagtaatgcagagaacctgggcaaagctgcctggagtccccgctctgccacttcccagctccccgcccctccctgacagtcaccaaaaagaaagtcctggccaggcgtggtggctcacgcctataatcccagcactttgggaggccgaggtggtcgggtcacttgagctcaggggttcaagaccagcctggccaacatggtgaagccccgcctctagtaaaaatacaaaaattagctgggcgtggtgaaaccccatatctatctactaaaaatacaaaaattagccaggcgtggtggcacatacctgtaatcccagctactcgggaggttgaggcaggagaattgcttgaacccgggaggcggaggttgcagtgagccgagatcgtgccgctgcactccagcctggcaacagagcgagactctgtctcaaaaaataaaatcctgcccagctgccaagtgtctttcctttcaccacgaacttggaagtgcacgggtttctttgcagagtcttgtagccctggtgatagctgcctccccataagccagtaaaacactggtcttttttctctcgctcactgctcttggctgtcactgctgccctggcggtctcctcccccacagcagccatcctggcctgggtccgcgggtggccctcatccacccagacaccctcagcagggcaagaggagtggttcccatggcctccctcctccgctctccaccgcaactggttctgagccagggacaggctctgtctgggaggcaagaagagcgagaagattccattctcttccagaacagcagagacacaaagcgcagagggccccaagaacactagccagccattcagtaggggcttaagtctctgcccactcctaacggatgctgctgtgcccagagcctctgccacagcacagacttgaccgccaagtggctcctacgaaagtggccattttccgtttgaaggtccctcatccccagggaaagcccgtggcctaggggcggccacctgtgaactagcaggagatgctgtctgcagccacagccctgccggaaaagaagtgggagtcgctgatgctgcaagacagagacctaaaccgaagtgtggggaggacactaggaggccccaaaaaccaaaaagccagggaggagcttgggaggagaggaggcatgcagcgtgcaagccttgcgatttccttggaagcagccacagaagcagagggcgggcgagctgagctgcagattgttagacctcagacctggaactccctgaactccctgcctgggggtgacaaccccctcatccagcctctgcacagcaagaagtgcctccccaagccccccacctccccgtccctgccacagttcctgttctttggagtcttcggagactcctttgtccttaaaatttgactctgtttcttcaggggcacagtggcagatcatccagagggtcctggagcagtccagttccagcgccgtcctgccacccctgtgggtgtccccccgggccagagaggagtgacaagtgggaggaagtggcatgtgccctaaatggggaggatgtgggtcccagagccccagcagcctaccccctccaccccagtttggggccctcccttgctgcctgcccgcccctgccccttccgccatccccagctgcctttggtatccaagtgacagcctgggcccttcccacccccgctaaggcctcctcctttcatatggtaatggcttgctctacacagccctagtcccacagatgtgtgggctacccctctctccccatgcctttgggaaactttcttcttcctgggaaacagaatctggaccctgccgaggacaaggaccccggaggcctcagtgggagagttgtggggagggggtcataacagggcttcttggaatggaccagctggaagccagcctgcttttctctcccttcctccctggtcactgcttccctttgagctgtccctggacttcccaccccacccccagcttcagagattgaggtggcggttgcctggacaacctcggttcttctctgcggtccaaaggagagggctgctgggcaagtaaagcagggctgcctgccctgaggagcctggaagaggggcacactggggtcccctctgtcgtggaggagtatggacaggggctgagggggccacgcggaggccccaggatgggcacagactccaggactgccgctggtagccgagtggccaagctgttaaacctttgtctccatttcctttttcagaagggtctgcagagtctgcaggtggcgcgcacattcgtcatgatgctgaagagatgagcagagtgcttagtctggggcccagcgcactcatctggaagcatgtcagcggagccgcgggacagctgccacggacggcagtggccccggattcatgtcccgagtctgaagagagctcctccctggccttttggtttttggggcctcctagtgtcctccccacacttcggtttaggtctctgtcttgcagcatcagccactcccacttcttttctggcagggctgtggctgcagacagcatctccagctagttcacaggtggcccgccctaggccacgggctttccctggggatgagggaccttcaaatggaaaatggccactttcataggactgtttcaggttacaggggtcaccccttcctgtccctaccttagactcccaaccccatcgctgcacctggcctggcctcctctggaaggaagctcagatttggagcctctgccagggcagggagcctgttggaaccagcccaggccagccggctcattcctggaattcctacctcctctcactgccctgggttggcaccaggtgctgagtgggcctcaggccaactgtgggcatgggctcgatgccgctgcttcctcctccacatcaaggcatcagccgtatctcaccccaaaaggcagagaggaaatccagctaagtcccacgcccaagctctgtgctggcttctggagggaagacacagccactgatcggcacttttggttcatgtgtcctcctacaacaaatgcgaacaaccatacacccttcacatggcttatgtctagctctcaaacg

SEQ ID NO: 8772 - DNA, 122 bp, Homo sapiens
ggggccgggctcggtggctcacgcctgtaatcccaacactttgggaggccgaggtgggtggatcacttgaggtcaggagttcaagaccagcctggctaacatggtgaaaccctgtctctact

SEQ ID NO: 8773 - DNA, 14471 bp, Homo sapiens; identical to SEQ ID NO: 8771

SEQ ID NO: 8774 - DNA, 122 bp, Homo sapiens; identical to SEQ ID NO: 8772

SEQ ID NO: 8775 - DNA, 1335 bp, Homo sapiens
cttttttccaaagaaaaaccactgtggtcatttttatttttttaattaccgaaggaaaatttctgcatacccaaccatgaacaaagaaacacaaagttatggtgagatggaatgccagccattcacttaagtcgttcttaggtcctcaggtgtttaagatccttgtcctggcaaaatggcaaatgactacatatcatggatctctgggatcaccccacagtattttgaatggtgactgtggtatccaagaatgccaagggtgttaattaaacatctgatctgttgctacactctgtccacctcttgttatacgagatgactctgaggcctcccattttactataaaactgtttattatcagcttccttgcaccccaagttccaagttctgcctgccatactggatggcctcccggcacccacactcatgggcttccctcccaggacatgccccaccccagtgggcgtgtcacgtgccaggtgtccacacctcccagtgcatcttgtttcctcaatactagacccagttggctagaaggactgtcattaccaatagcacatttagcactgaaggtactgactcatggaaattgtttcaaatacctctgcttgctctccagggaaacagatcaagagaaaatctttgaggtatgtttggatcatcaaaccatctcatatgagccatgctaaggtctaactaatccagcaagattataattgaccacatgatagccatcaaattaggcttgagttcaagcgtatgatccagtggtacttctatgtgctctacagttcattggactccctgtgtaatcactgtgtagagtacctcaaacccattttatagaagctggagtggcacgtgtttattgttttaggtgattacagatttttataatcttttaggatgtatttttgacttattcagttctgagtccttggtcaggagtacgtggtcccgttttactagttttcctatggtaaaatgcaatgtacctatttttttcattccatgaatattttaatgtttaaacaatccactctacactaagcacataatgagcgttcagcctctgacttggcactgaggttatgggcatgtgtggcacaggatagtggggagggcttgagcatgaaacttcgtgaaataagtgtgatctttgggcaaggcaggtggctcacacctgtaatcccagcactttgggaggccaaagccgtcacttgagaccaggaatttgagaccagcctggccaacatggtgaaactctgtctctactaaaaatacaaaagttagctgggtgtggtggcgcacatctgtaatcccagctactcgaga

SEQ ID NO: 8776 - DNA, 3204 bp, Homo sapiens
ccagaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctggtgagttctgggctggggctgggcctcctgcctcctgcctctggaggtctgctggtgtctgagccatagcgctttgtttagtttttctgaatcaactctgaagtggttgaaggtttccacataaaaatccatgttgctagctttcctggaaagacaaacagtgccagacccaggacacccaagtactgttgagaagtgcccaggagcaccttactatgcaacgagtggtgagtttgtattgtaggatggtttttctcttctcccttttttttaaaaaacaaggatagggtaggccaggtgtggtggatcacttgagctcaggagttcgagaccagcctggctaacacggtgaaaccctgtctctactaaaaatgcaaaaattagccgggcatggtggcacatgcctgtaatcccagctacttgggaggctgaggcaggagaatcgcttgagcctgggaggcagaggttgcagtgagccgagatcgcgccactgcactccagcctgggtgacagagtgagactctatctcaaaaaaaaaaaaaaaataagataaaaaataaaacaggaatggggtctcatttgttgcccaggctggtgtcaaactcctgaactcaagtgatcctcccacctcggcctcccaaagtgctgggcttataggagccagccactgcgcctaccctgtaggacagttttctgacaggtggaggtcaagggtctagttagaagctctttctttcttttctttcttctttctttcctttttctttcttccctttctttcctttctttctttttgttttaaagatactggctctttgttgcccaggctggagtgcagtggcgcagtcatagctcactgtagccttgaactcctgggctcaggtgatcttcctgcctcagcttcctgaatggctggtattacacgcatgcaccaccatacccagctagtttttatatttttatggtttgcagagatggggtctcattagaggcttttttgctaaagctgagcttacatgccgtaaaactcagttccaaagtatacagttcagtggttttttaatagcgatagggttcataaaccagtgtttctcagccagaggtgattttgccccccaaggggtattatgcattgtcaggagaccagaaagggttgtcacaactcgggggtgccactagcatctagtgggtggaggccaagggtgctgcccaaatcctgcagcgtacgagatggctccatgacacagaatgacctggctgcggtgttgctgaggtggaggcgtcctggtctaggctggtgctccaggctgcttacagcctgctgcctcccaacccttcccgcaagctgaaaaaaaaaaaagttaaccaaatttctaatgagtccctggggcacatggcagagagggtggggaattggggtttcctgccatggggagggagaggattgagctccaaggtaaacagaccccaaacccttccctcccacatgtaccgcctcccttcccctggggtgtcattggaggctgctggggacattggcaccgagctccaggcctacttgctgctaggtcagcatctgggcctgtcaggggctcagccagcaagaagagcagccagacctgcagtttgggtgcagtgatgagaattagggtgggaacctgtgtcctggtcaccatcagtgatatctgctgagcatctgctgagccaggtactgtgtatgtgtcatagtggccccagggagcaaactgctgtggccagtttgcccagacccacttcagaggatccagctggggctgctggaggcctggcctgcaggtcacacctctgcactccaatttacccctcaggacgggctgtgaagggggttgagaggaatctctggaccaccctcgaagtgcacctcagccagcagtcctggtgtcttgccctcttgtgtgtggtccaacccagctagagtcttaggctgtgaacttcggatgtctgataaaagacagaggtcaggatttatgctgtatctggaaagatggggagctttagagtccaacacgcaggtgtgatttcctcaaatcctgaggccctggggaagtctcttctctctgtccaggctgcaggcctcactcgttgaaccagagggcctctaaggtcatgctgaactgcatggaggcaaattcaaaaccataataggactcaagtctggggctcaggcaagtaatggactcctgagagggggccttggcgtttcccccgttacccagcaagttccacggaggaccagggacattttaaaccattgggcctatggcatcgtgtccttttgggaacatctgctgtgaggcaggtcacatgaaggtggcctctgagggagacagggagcaaagatgagggaggatgcagcataggtggggcctggatctgcagctgagttgggagcagaaggaacagccagtgcggaggccaccctcttgtggaggcctgggggtccctgtaggttgcccgacccactgtgaccctgagcctcttcccacagaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcagc

SEQ ID NO: 8777 - DNA, 695 bp, Homo sapiens
tgccctcaaggggaagggattaacctgggtgtgcacaccagggggtggggaaacttcccattctattaatgcgtttaggttatttagaccaatgtctcattaattttaaaaaaattaaaaataggccaggcgcaatggctcacgcctgtaatcccaactttaggaggtgaaaggatcacttgaggccaggagttaaagacgaacgtgggcaacacagtgagatcccatctctacaaaaagtaaaatacatttacaataaaaatctacaagttctgacccataggagagtggaaaactcaaaggctgcttttgtcctgaaagaatttgcctattctaataaaacagctgaggttgaaacggctcagcctctgaaaggggtctgacccttccttgagcccttgcctccagtgacaatctcccaagctaagggagaaaaggaaccaaaagtctgcactcctctctacctctagcagtgcagggagcgaaggaaagacaagggaagaaacccttcagattttcagatcaaattcacatcactggccatccaagaaatcttaagctctgcgtttatcgtcaaccatttctgcatgagggaagcaaacagtccttgctgaaggaaggtgcctgcatcctgggcctcggaacccactgaaataatttagcgaagtgcataataaaaataatatttgccctta

SEQ ID NO: 8778 - DNA, 575 bp, Homo sapiens
gtggcacgaggaagcagtggaataatcctccatggcacaagggagcggtggaataatcctctgtggcacgcgggggggggtgtggaataatcctccgtggcacgagggggtggtggaataatcctccgtggcacggggggtggaataatcctccgtggcatgagggggcggtggaataatcctccgtggcacgagggggcagtggtataatcctctgtggcacgaggggtcggcggtataatcctccgtggcacgaggatgtcaccgcattcgtcactcttagctgcagtgcgtgtgacagtcgccaggggctgctgtttgaggaatgggagttgcctgcgtctgctctgccccaggtggtttgtaggtggtttttactccttgccaaagcccacacagccccgcaaggcaaacagtgttcaactcttttcatggctgaaaaactgggacatcagagaggttaagacactggccagggccacctggcagggaagcttccgggccttgcctgcaccaggactgtccgatggggacgtcatctgcctcccagacggtatcttaaaaaaaaaaaaaaa

SEQ ID NO: 8779 - DNA, 576 bp, Homo sapiens
gtggcacgaggaagcagtggaataatcctccatggcacaagggagcggtggaataatcctctgtggcacgcgggggggggtgtggaataatcctccgtggcacgagggggtggtggaataatcctccgtggcacggggggtggaataatcctccgtggcatgagggggcggtggaataatcctccgtggcacgagggggcagtggtataatcctctgtggcacgaggggtcggcggtataatcctccgtggcacgaggatggtcaccgcattcgtcactcttagctgcagtgcgtgtgacagtcgccagggctgctgtttgaggaatgggagttgcctgcgtctgctctgccccaggtggtttgtagggtggtttttactccttgccaaagcccacacagccccgcaaggcaaacagtgttcaactcttttcatggctgaaaaactgggacatcagagaggttaagacactggccagggccacctggcagggaagcttccgggccttgcctgcaccaggactgtccgatggggacgtcatctgcctcccagacggtatcttaaaaaaaaaaaaaaa

SEQ ID NO: 8780 - DNA, 576 bp, Homo sapiens
gtggcacgaggaagcagtggaataatcctccatggcacaagggagcggtggaataatcctctgtggcatgcgggggggggtgtggaataatcctccgtggcacgagggggtggtggaataatcctccgtggcacggggggtggaataatcctccgtggcatgagggggcggtggaataatcctccgtggcacgagggggcagtggtataatcctctgtggcacgaggggtcggcggtataatcctccgtggcacgaggatggtcaccgcattcgtcactcttagctgcagtgcgtgtgacagtcgccagggctgctgtttgaggaatgggggttgcctgcgtctgctctgccgcaggtggtttgtagggtggtttttactccttgccaaagcccacacagccccgcaaggcaaacagtgttcaactcttttcatggctgaaaaactgggacatcagagaggttaagacactggccagggccacctggcagggaagcttccgggccttgcctgcaccaggactgtccgatggggacgtcatctgcctcccagacggtatcttaaaaaaaaaaaaaaa

SEQ ID NO: 8781 - DNA, 342 bp, Homo sapiens
aaacaaaagaacatgggcagggcctctcgcccagtgtggtggctcttagggacgcagagcttcctggccgcccttcggctctgattctgtttgtccccacagcagtccacgggccgtgagatctcaaaggctgggcactggacgctttgctctctatccttcacaccaagctggtctgcgctctccacctgctggggctgcccagtgccccttgccagagacccagctcagaaactcagaaatgcttccagccacccgccctcgggaccggcgtgaagacccggtgctggggctcctgggtggggctgtcactgcctgagtttggggcctgcccttcttgtc

SEQ ID NO: 8782 - DNA, 342 bp, Homo sapiens; identical to SEQ ID NO: 8781

SEQ ID NO: 8783 - DNA, 342 bp, Homo sapiens
aaacaaaagaacatgggcagggcctctcgcccagtgtggtggctcttagggacgcagagcttcctggccgcccttcggctctgattctgtttgtccccacagcagtccacgggccgtgagatctcaaaggctgggcactggacgctttgctctctatccttcacaccaagctggtctgtgctctccacctgctggggctgcccagtgccccttgccagagacccagctcagaaactcagaaatgcttccagccacccgccctcgggaccggcgtgaagacccggtgctggggctcctgggtggggctgtcactgcctgagtttggggcctgcccttcttgtc

SEQ ID NO: 8784 - DNA, 101 bp, Homo sapiens
aggctggagtgtaacggtgcaatcttggctcactgcaacctctgcctccggggttcaagggattctcctgtctcagtctcccaggtagctgggactatagg

SEQ ID NO: 8785 - DNA, 2134 bp, Homo sapiens
gtcttgggttcttttttattttttttaatttttattttaggttcaggagtatatgtgcaggtttgttatataggtagactcgtgtcatgggggtttgttgtacagattatttcatcacccaggtactaagcctagtacccaatacttattttttctgcttcactcccttttcccatcctccaccctcaagtagtcctcagtcagacctgaattctgattccagcttggccacgcttagccacaggcaagcccctgaacctctctgtgctttagtttctttgcttataaacacctaagccatgcggctgttgtgaggactatttgagttgtacttatctcgcccagcacagagcatgtcctcaacagacagtagcttcggggctggaaaacatgtctaacgtgtaaaggcaattcagcagtcttgttcatgcatttttgtatgcaagtttctaatctgtgttacctctgtgggcatatacatcatggggatttgtagcttcattttataagaagctaatattggtcatgcttacctactattcttgggtgtttgccagaggctgctttggagtatatttgaaatggccatctcttgcagtattttccatgcctacagattctgagttttcaccttgtccttccgtttgctgtcagagcattattttagcttctaactttgcagtttctaatcatatctacgtttttccaccacaaggaaagaatgttgagaatgagagtgaaggacagagataacaagtaaggctatacctgcttagctgctggatttccttccctcttattttgatgtggcactgtttgatttccctgtttgcaaattgcgtcttgcttcccattttgccaaattttgatcattttcttctttcagaaaggaaaaaaaaaacacaaacaaccaaattttattttccatatagtttaattgaattgatggctgctgtcacaaaataaaataaaaacctcacaaacaagaaggctgcaaatcctaggattaggctacttctgaagttttaaaaattcttcaaggcatttatttgcaaattctacccatttgcatattttataagcataatacaaaaatgtattatttatcaggtggtctaggcatgcttgtggaaaatgaatggttgcaaattcaaccttcattttaaaatcctcattgtaaatccatccctctaacttgcaggaaaactgggtttttcaaccctagttttttctgatctacttaaaatactctagactccacactgtgagcaacttttattgagtatgtgtctgtaatttgaagagaatggctgccaatacataaaatcacaaaatacagaataatttacaatgtcaaaatcacctgatctcattggctccattttatctggtcatcccactgacatccatgccaaagatattcttgcaagttttcgggcagaagtatgatctcacacttaggcaatttcagttgtcaatgacgcaatacttgggagtttcatgccttgatatcttgtctaacctttatgtacagtcaagagaagaaatctgatttgagctgttgctggttcctgttgagtttagactccatgggccagaaaataccatacccccagatctgagacaattgatgagtgaataatcattacagtagaaaacaaaattaaatgagcatgccattctttggctttttgccattaaatgagcatgccattgtttggcttgtattttatgattcagtatccattttaaatatccatttttaagtatccattttaagtgagactttttaagtgaaatattttaaagtatccatattaagtaagtatgataactatattttaatatgattgctctctttggtgaaatgtaactaataggcagaaaatgctgcaagtggaggaggatttgctaaagcatctattaaggcttctttttgtaaggtagttttcttcaggcacccagaagacacttttgtccctgtagagccacatgatgttttctggactataggaagcaagacactggtacaatgacaaagtgctggtcctctctcctggctcccttccgcttgcctgtcatatcacatatctgaccactgatttgtatcctgtggacacagcctgtactatgg

SEQ ID NO: 8786 - DNA, 913 bp, Homo sapiens
aaagtatgctagtagtcattgtgttcttcactatcacacactcagagtaaaaaaatacgtttcacttaatcctaaatgaagaagtaaaaattactagttttctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattagaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctcaaaaaaaaaaaaaaagtctccttctcttacaagttagtcaccttactcagtttattacagcaggagttcccaatcctcaggctgtggcctgttgtgaactgggcagcacagcaggaggcg

SEQ ID NO: 8787 - DNA, 913 bp, Homo sapiens; identical to SEQ ID NO: 8786

SEQ ID NO: 8788 - DNA, 748 bp, Homo sapiens
gtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattaactgggcttggtggcatgtgcctgtagtcagttacttgggaggctgaagtgggagaagaggattgttgagctcaggaggtcaatcaaggctgtagtaagccgagattgtgctactgcactccagcctaggcaacagggtgagaccatgtct

SEQ ID NO: 8789 - DNA, 748 bp, Homo sapiens; identical to SEQ ID NO: 8788

SEQ ID NO: 8790 - DNA, 609 bp, Homo sapiens
atctaggagccttgttgaactgagtaattaagggcaattaaacttttctgcttgctctctgcaaaatatgctaatgatctggtctgctggaaggtggacatatgcagtgctgtttcactgctgtcagacgctgctgccctggaaggtccccctggagaaggtgtggcatcaccaggatggtcaggtgggcagtgggttgagcgtgcagcctcgtacccagcctcctgtgtcctggctggctgttccaggacttgcaccttttcagcagttatctagacctggccgcagtggcctgagttgcagtgattcgtattcactcattctttgatgttctagatccaccattcattcgttgcgttatttttctgggatgatgaagctaccagggttttgtgcgtgttgtttcagcatatgacacgtggcaccagctgtacactgcccttctggttagtgttgttcttggtcaagggctccaggctgtcttccatgctatcttcatgagtgggtggcagcacgtgcccaacgctgcccactgggagaagcattgatactgtggccactcactgcagagagggttttttttggcacagcaaaaaaaaaaaaaaaaaa

SEQ ID NO: 8791 - DNA, 374 bp, Homo sapiens
ttgttaaatgaaaaatggagtttacaggataacataggttgattcctttttgtaagtatttttcttacagcttttaaaatattcaagcaaggagttagtgactggtgtctctggctgttttggcggtgggatgtatttatatggactctaacagaatgtcagatgtgtggcaagggctcagaatggtggtggtgcttgttgatagagattttagcagaatcactaacaggctacgaagaagtaaatcttggttgtcttttgttcatggagatgttttttatttgccaatattcgtagtttgattactctgtgattctcctgcattttgcatttacatagagaggataggagtagttctcagggtgtatactgtc

SEQ ID NO: 8792 - DNA, 34650 bp, Homo sapiens
taaacaggatcttgctctgttgcccagactggagtgaagtggcacgactatagcccactgcagccttgaactccgggctcaagtgatcctcccgcttcagcctctccagtagctgaaactacaggcacacgccaccacgcccagctaatttttatttttattttgtagagatggggtttcactatgttgccccggctggtctaaaattcctggcctcaagcgatcctcctgcctccgccttccgaagtgctgggattataggcttgagtcaccaccgtgcccagcatacatctgctttctgaatatttgagaggcggaaggcacaaggcgtgacaattgatgggatttgggatgtaaagagcaagagaggactcaagcacagtcgcctcgaggtttctagccccggctgctgtcaccaaccactctcaggaaggtaggcagaaggttacgcaggagaaactgtaggggtagttctgaggccctggaaggggtagttctgaggcccccgggggtgcggagctgcaggtccagggaggagtggtgaggctggaggaaggtgaggctggaggaggaggttcaggaggctctgaggtaaagatggaggctggggccttgggagtcgaggagtttacccaagacgaagcatctgtgtggaagaaaagataaggctgggcgcagtggctcacgcctgtaaaccaagcgctttgggaggccgaggtgggcggatcatctgtggtcaggagttcgagaccagcctggtcaatatggtgaaaccccttctctactaaaaatacaaatattagccgggtacagtgcacctgtaatcccagctactcgggaggctgaggcacaaggatcacttgaacccgagaggcagaggttacagtgagccgagatcatgccactgcactccagcctgggtgacagagcaagactccatctccaaaagaaaaagaaactataaacatcattgaaagaaactaaagaagacctaaataaatggaaggaaatcatgttcatggattaaaagacttaatattattaaaatttcattacttcagaagtgatctacagattcaacacaatccctatcaaaatcccagctgtggctgggtgtggcggctcacttctgtaatcctggcacttcaagagccaaggtgggaggattgtttgagccgagaaatttgagaccagcctggcaacatgatctctacaaaaaatatagaaattagccaggcgttgtggtgccagcctgtagtcccagctacccaggaggctgaggaaggaggatcgcttgagtccaggagtttgaggctgcagtgggctatgatcacatcactgctctccggcctgggcaacagtgcaaggtcatgtctcaaaaaaaaaatcccagctggctttttttttttttttgagatggagtcttgctctgttgcccaagctggagtgcagtggcggacgatcagcctcagggcaggccatctagaagaattaccaaaaacaccaacccatttgtctctctataaagtgctgacatttgtgctctgcaacgtacagctgagagagcacaaaacttgtctgactcagcacagtctaggaagtcaagcagctcaatcttgaacaggacagtggtgtttggggggatcaagggaggggagcccagcgttccataggcgtagttcggtttgaacagaaacctggccagctctcctctctgcatgctcagaaggcccagctccatgccccacaatgtaatatctgtaagaagggacaaagaaggtgggtgaagcttgctcagtatcctgcttaatgctatcagtttcttccccctctaagtcagcagtactctggcctccatgtctccctcacacagttccctcttcctgcaatgtcttcctcctgagcctgtgcccagcttctagtgatagaaattttattcaaacttccgggctcagttcaaatgccccctcttccaggaagccttccctgaacttcccagctagaattaatcatgccttcattaagcacacccacaacactgctttcacctcccaggcactcatccgattctaccaagtgagctgagtgcaggtcagtctcctctactacattgtgaggtccttaagggtggagatgttctaatcttctgagtacaacctctcttttcaccatgtattgtgggaagtaagcattcgtcgatttttacttaataaatgaacaaagaaacattcccagtggtgagttaagtcagagtgcaaagattataccttgcccattaagccatctcccaaatgcctaggtctcaaggggagagaacatggctgttttaccaaaacccagcctcagcaaagtcaattcaaagaacctgcgctctgagcagtcttcccagcctgaggcatggtgcctcatctcgctcctaaacaatcccttcttctccagctcctactctgaatttaccctctccaagtttcattagccgaggagttttcctaaagtaattagaatcgaagggtctgtccaagtgttccaggtatccatagtatttcactagaatagaggaaagaatgtaaggaaaatggacccaaaacacccacgccaccataatatcgagtctctcatgatcacacagaaacaatgcgatcagatgagcttaagctgcccgacaccacgaggtacaggaataaatctctctgcattttaggagcctacccttcggctcagaggttcaagagcttcatggaagcatcacgcaaaggggacataggggtccttagctttcctcttaaaaaaactaattcatggcagaagcagcggctcacgcttgtaatcccagctactggggaggctgaggtgggaggatcacttgggaccaggagtctgagaccagcctgggcaacatagaaagtgccccatctctacaaaaatattaaaaattagccgggcatggtggattgcgcctgtaaatctcttatttgggaggctgaggctggagaatcacttgagcccaggaagcagaggctgcagtgagctatgttcgcaccactgcactccagcctggggaactgagcgagaccccgtttcaaaaacaaaaatccacttcaaacaaagcatttccaaccccattaaatgctttttgaaaatgaggcctctctcttcccaacagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacggtgagttgccaggtgtggcccgtaatcggagcgcacaaaacatgatgggacacgtaacgggaccacacagggcacattgggcacttgcaggggcgcgaggtggcggcacgtaatgggagcgcgctgagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctgggtacgtaatgagagcgagcgggaaatgatggggcacctaacgagcacgcagagcatgatggggcacgggtgcgaggtggggcgcacagtgggagcgcgtggggcatgatgggacacatggcgaggccgtcagggcacaggggaagcacttttggaacacgtgagtgacagggctgccgcccttgaaggagccctcggagtggctgcgtggtggggcacgtggggcaggttcaggaaaaaggatgcagcatgtgattgcagggcaacctggtgaggacacgagagccacctgccaccagcagggttcagggctcccagctgtgggttacttccaccttctttcactttccctcttccattgtattctagagaatttaggcccagacaagacactgattgattgattgattgattgattgacagaggctcgctctgagcccaggctggagttcagtgatggatctcagctcactgcagccgccacctcctgggctcaagagatcctcctgcctcggcctcccaagtagctgggattacagacgtgcaccaccaggcccagctaatttattttttagtttttaatttgctggtaagatggtttgtagctttgttgcctaggctggtcttgaactcctggcttcaagcgatcctccagtcttgacctcccaaagtgctgggattataggcgtaggctacagccaactttcaatactgccccattgggggttacgtttccaacacatgaaattaggaggatacattcaaaccacagcagtatattatgaccataatattcattaactgtgtaacaggctgggcgcggtggctcacacctgtaatcccagcactttgggagaccagagtgggtagatcactcgaggtcaggagtttgagaccagcctggcccacatgatgaaaccgcctctctactaaaaatacaaaaaattagccggtgtggtggcaggcgcctgtaacctcagctacttgggaggctgaggcaggagaatcacttgaatccgggaggtggaggtggcagtgagcctgattgcaccactgcactccagcctgggcaacaagagcaaaactctgtctcaataaacaaacaaacaaacaaaacctgtataacagagtgtcattgaatttctaaacgttgaaagacttcacattaaaaaaaaactcacaatttaatattattgagtgaaagaaaccagacacaaaagggtacattctatatgatgctgtttatgtgacattcaaaaacaggccacatgacaacatggtaataaggacagtggctgtccttgttaggagttatgactggaaggaggcaggagggagctttctggaaacactgtacatcttgctcttgagagtgcacgtatatacatcaagtgtttatcaagctgtgtggttaagatttgcacacttgtatatgttatacctcgatttaaaaaatctaaataagtaaataaagataccttcaaatcttttaaaaaaaaaaaaaaaaagaggccaggttcggcggctcacacctgtaatcccagcactttgggaggctgaggtaggaggattgcttgaggccaggagttcaaaaccagcccaggcaacaaagtgagacccctgtctctactaaagtaaataaaacaataaaataaaaaaaaaaattcgagagatcgaaccatcatctgccagtttgtattagaaaaaaagagagagagaaggaagactgcgtgcaataaggctcatgcctgtaatcccagcactttgggaggccaaggtgggaggattgcttgagcccagaagttgaagaccagcctgggcaacaaagcaagacccggtatctacaaaaaaaattttaaaaattagcttggcatggtggcacgtgcctgtagtcccagctactcaggcagctaaggtaggaggatggcttgagcctaggagttggaggctgcagtgagctgtgaccacgccactgcactccagcctgggcaacagagcaagacactgtcttcccctgccccccagccccccaccccccccccaaaaaggatataagagcaagagattgagattcagaaagaactgtttcccagcacctgtctgctcctgtcggggtcgtgaggtgtggacagtgtgcctagtccctctgtttctgcccctcctccacagtggccaaggccagcacttgaatgttatcagagcaggcccaacaaaggctgcctccccagtcctgtgatgtaacccagtttccacctgattctggtgaccttggggacacaggggtgttgctggggaaggggaggagagaaggggcagagaccaggcagtggtgcaggcgtccagctgcacttcccacttctgactctgtgcctgctgttccctgctgggaagaagaaaagccagtgatgctggcttgaggctgtagtgggaggcccagcggattgtgagaagccaggtattccaatgtcgggctctcgctgggggcttctggtgcttcttctgtctcactgacaagctttcataggggagcaggtgggagatcagggtagaggccttgtaggttccaggctctctagaattacctgggagtgtcacctataagtgtagagttctgggtctcactggagaccccctgaagcagatcctttgaaggtgggcctctagaatctctattacacctatgctttcaacagtttcctgaaagtttgggaactgatctagaaggtggggagcttgcctaggttttgctgttcagttctaggtccggatgcatgctggggctggaccttgcattattagtgtcactgcaaatgaccctgcagatggcccctttcatgcttgtctccaaatttgagtaaaaaatgtagacacacacacacacacacacacacacacacacacacacacgtatcttcaagggaccagttttttcactgcagtcttttgttttacagctgtggaaactgaggcccaaggtcatgtgggttaggactgggatccaggactcaaagtgtttcctctaaaattctggtgctccttagggttgagggtggtgggtgagtgctggacagggggaggggagtggacaggactgaggtcggatgcctgtgtttcagcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccagagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggtggggagtgagggtgcaggcggggcggcggggcccgcggggactggatcctgtgctctctggcgctatcaactggcaccaaaacggatccagctatcctcgatttccctgcagccctgccctggcgcattcattccttagtgtttgagcggcagctaaacccaggtgctggggattgaagctacacgcacaggatgggagctccctggtgtcacgtgctcaccccttcctgttttttgtttgcagttctggtttgtttctttttctttttttctttctctctctcccgcccccttcccttcctctctctctctctccccctccctcgcccgccccccctttctttttcttctttctttttggagacagcgtctcactctgttgcccaggctggagtgcagtggtgtgatcatggctcactgcagcctccaactcctaggctcaagcaatccacccacctcagcctcccgagcagctgggactacaggtgcacaccaccatgcccagctcattttttatattttgtagaaatggggtctggttatgttgcccaggctggtgttgaattccttggcctccaacgatcttcctgcctgggcctcccaaagtgctggaattataggcatgcaccactgccctacgccccttgtttgtgtctggacactcccctgtttgcactctctggtgcatgagagtggggacttcattttgtcccctggtgtatttcagtgcctggagccatgcctggcacattgtaaatgtccaaaatgctgaatcagtgaattcctgcctttataggccatcaccaaacctagcagatcattctttaagatgagtaataataatacctgactgggtgttatatatataaaacacctgttataaaacacgtgactgggtggcttatgcctataataacagcactttgggaggctgaggtgggtggatcacttgagtccaggagtttgagaccagcctgggcaacatagtgagaccctgcctctacaaaagtttcaaaattagcctggttggccaggcgcagtggccactcctgtaatcccagcataaagctggagggagcatgggtgggggcgagatagggccagcgaggtaagctgcggctggggcatggagaggccagtgtgacccgggaatggatttggagtttattcacaggatgagggagaaaggcgggggctggagtgttttaagccagtgatgacatgctcagatctctctggcagaggggagctttgagggtgaggcaaaaggacagtgagagatgaaggtgccaggacctaagttggtgggaactgggacaaaggcctggggcagaccaaagacaaatttcaaacagaaaaaaaccctgacaactgtgtgtggcaaggagggtgagggatggggaggttgactccagctctgtaattcccccttgcacagaggaagtgatcgcaggggaggatccggcgtgggcaggtggagcgggaggtgcctggggatgtgcagtcgggttgaggggtgtgcagaccaggacagcggtggggctcagggcaagaggtgtggagggtccttcctcttggtggtcactgaagtcccctttggtggagaagaccaacccaggagagtctacatagtgataagggaagacactgatgatgaccccaaggggtaccaggcttaaaatctggattgagagagagagagccctgaaaaaggaatagaaagaatcctcagagcaggaacaccggctgagtgtggcctcccggaaatcagagagacagactgaaggaggagatcacgtgtgtgaaatgtctctgaggactgaaaagtgttaaatgtagcagtaagaactgattatcttggcaagagcaggtttaggggagtatggaaggtggaagccaactgcaggtgaggaagccgagtttatgttttattagttgatgggaaggagggagggaacaggctgggagattgtctgtcctttgtagttaggatccagcagctcagcttgggtccctgttttagatttgggcttaatttttttttttttggtagagacagggtctcactattttgtccaggctggactcaaactcctggcctcaagtgatcctcccgtctcggcctcccaaagtgctgggattccaggcatgagccactgttcccggccagatttgggttttgatgatcccgaggctcttctctgttgcaacacagaatacaactaaattgcactcctttattgccctctttaaggtgttcccgttgcctcctgtttattgagatcttgagatgctcgattgatgggtgcattgatttgcataacttagttcttctcacggggaaggaatgagtcccgtctgtctgcctggggagggtgacattggaatgctgttcttaggcctctgtgagatgttctgatgcctcattctccagagcaaggactctgtccgtttatgccagcaagtgcttgattctttacccaactcccttcctgaaagccccttgcagctctctggtgcttgggcacgatccaagccaaaaattctgtacattgcatgggtataaaccgacgggggctctggtcaagtcatggagtagatggtggtccaggagtcctggttggcacccccaaggctaggtcagatttggggcccgggcagtccaggagaagtgcatttatgtcagcttggggaggtcgcaaatccgtgctgtgtccaagcccaccaggaatggattcaggtgtttataggtgtggggattcaccaggttaaacccaggcccgtgtgagcaccactggccctagaattagcctcacctggcgccggcctttttgtgatggctcctgattaaatacccactaattctggatctgctggtgaccacagagttcacctgatgggtcccctacaggcagcattcaatccaggaagtgccagcatcacatggtgacttctggtagctgtaacatttagtgactgtctccatgtcatgcacaggggtgacatcgagaccctcttatgcctgggaagttcctgctgtcaatgcagaatattctctttttttttttttttttgagacggagtctcgctctgtcgcccaggctggagtgcagtgggcgatctcggctcactgcaagctccgcctcccaggttcacgccattctcctgcctcagcctcccgagtagctgggactacaggcgcccgctaccacgcccggctaattttttgtatttttagtagagacagggtttcactgtgttagccaggatggtttcgatctcctgacctcgtgatccgcccgcctcagcctcccagagtgttgggattacaggcgtgagccaccgcgcccggcccagaatattctttgaagaaaaaaaaaacattagagatgggatttcactgtgttgcccagtctggtctcaaattcctagcctcaagtgatcctcccatcttggcctcctaaagtgctgggattacaggcatgagccactgtgcccagcctagaatattcttttttttttttcttgagatggagtcttgctctgttgcccaggctggagtgctgtggcgcaatctcggctcactgcaacctcctcctcccaagttcatgccattctcctgactcagcctccggagtagctgggactacaggtgcccgccaccatgcccggctaattttttttgtatttttagtagagacagggtttcactgtgttagccaggatggtctcgatctcctgacctcgtgatcagccagcctcggcctcccaaagtgctgggattacaggcgtgagccaccgcgcccggcccttagaatattcttgaattatcttattttttatttttattttttgagacagagtctcactgtgacacccaggctggagtgcaatggcatgatctcagctcactgcaacatcaatctcccaggttcaagcgattctcgtgcctcagcctcccaagtagctgggactacaggtgtgtgccaccacacctggctaatttttgtattttcaatagaaatggggtttcaccatgttggccaggctagtctcaaactcctgacctcaagtgaagtcccacctcagtctcccaaagtgctggaattacaggcgtgagctactgcgcccagactattcttgaacaatttaacctgttttggactcaagggtacctgggtggctctggttcccgccctggtttccctgggagtgcttgtggccattgggatactcccaagaaggtgatccaaggagctgagaaggggagggatcagctgctcatggggccatggcctgttgcctccaggaggagctcgcagccctcttctctgagctgaagcaggagcagaagaaggtggatgagctcatcgccaaactggtgaaaaaccggacccgaatcgtcgtgagtgccccttccctctgcccctgcctgggaccggccaccttcactttcctgtagagctcagttctcattggtcctttacagaaaaccatgccttccatataaagccagaactcaaagcattccggggcggggtggggaaagcgcaaatcctctcaggggaattcaacccagttgtcgttaggactggctccaagttggcttttgccctctgtgtccttgagactgagataacccaggacttgagtctcgggggtaaacagctgaaagcatgggcgtgactcctccgcccctgtgccacctgtgtctgcttgaccttgccagcctgtcatggtgccctcccagtacctgggtgcgcaggcgtggagaggctggcagccctgggccctggctgatctcctgaactgagaggcacatggggctgggacgcatagtgccccggccctggaggtggctgtgaaacagaaacaggagccgagcaagatccagaagcacttggcctccctcatttaccctcctcacccttgcgcggcaggcggtatcagccctgcctggtggaggcggagctcagggttctgcagggagttctggctccctcacagcaaagcccgctcgcccagggccttcctgctttccttcagttgtggaactctgggatatgcacatttaatagctgaaataggcaaagtggggtgtggtggcgtgcatctgtaatcccagcaactcgggaggctgaggcgggaggattgcttgaggctgggaggtcaaggctacagtgagctatgatcgtgccactgcgctccagcctgggcaacagagtgagaccctgtctgttaaaaaaaaaattaaaaattaaaacaggccaaagcagagcctctccatttgaaatgggagctggggccaccctccccacggccaccgccagggctccccatgcatggggtgaactccctgcccggcgccaggccatgcagcctcccctgagactcaggtcccaggaccaacccggtcaggaaggccctggggacaccgaggccagccagacagagcctggcagctcggctgtgactctgcagtgagcagccctccctgtcccagaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctgggtgagtggacagggaggcgtcccatccccatacccgccagggccttccccttcccaacagtgccctggcttcccaccttctagccttaacctccctctctcttgccttccagaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacatccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttgggcatggtggcatgcgcctatagtccctgctactcataaggctgaggtgggaggattgcttgagcccaaagtttgatgctgcagtgagtcatgatcatgctactgcatgatccagcctgggtgacagagcgagaccctgtctcagaaaacaaaacactagaggaggagcaggtgtctgggaggcctggcagaggggcacacgcctgatggctgagaagggcccaggacccgagtttgccaggcaagccgagggaacagtcctgtaaaagggggagtggcgtgcggactctggttatgagaagttcagggtggctggatgtaaggcaggatatcaggaggagtgggagctgggagaggtgggaaatggccagaagcaacatccaggagcaccaggcatcccttgcttaccgtcctcacccttgcgcagcaggcagtatcagccctgcctgaaacttgctctgcagattgtgggaagagagcggatccatgttctagacccaacaaacgaacacgtgcagttcccaagccttcctcactccctgtttatgggagactccttgtttctcacatttcttttagtcttagagacaatttggtcaggagacatgggtttaaatgaaggcacagagcctgggcacagcagcttacacctgtaatcccagcactttggaaggccaaggcagaaggatgacttgaggtcaggagatcaagaccagcctggccaacatggtgaaaccctgtctctatgaaaaatacaaaaattagctgggtgtggtggcacatacctgtaatcccagctactcgggaggctgaggcacgagaatctcttgaacctgggaggtggaggttgcagtgagctgagattgctccactgcactccagcctgggtgacagagcaagactccatctcaaaaaaaaaagaaaagaaaacaagaaaaaaaaaagtccgggcatggtggctcatgcctataatcccagcactttatgctcaagtctgcttttttttttttttttttttgagatggagtctcgctctgtcacccaggctggagtgcagtggcacgatctcagctcactgcaacctacacctctcaggttcaagtgatctcctgcctcagcctcccgagtagctgggattacaggtgtgcaccccatgctcagctaatttttttatttttaatatagatggggttttgccatgttgaccatgctggtctcgaactcctgacctcaaatgattcgcctgcctcggcctcccaaagtgctgggattacaggcgtgagccaccgtgcccagccttgagtctttatttttagagacaggatcttgctctgtcacccaggctggagcgcagtggtgcaactgtagctcactgcagccttgacctcccaggctcaagtgatcctcctgcctcagcctcctgagtagctgggacgacaagtgtgtgctaccatacccagctaatatttaaatttttagtagagatgggatcttgctatgttacccaggctggtctgggcctcaagcaatcctcccaccttggcctcccaaagtgttgggattataggtgtgagccactgtgcttagcctcccataaccctttgattcacgatactcataggctaagtgggtcctggaagctccggggtagccttctaaccaagatgctggctctggccactggaagtcaaactgggtgcacagaccagtgagagggcatgagggagcctagcaggggtgaacagcaaccctcagcctccccacagccctgcctctcctcctgcctctcctcggtctcctttgaggattcagcctctcgtcctcaccacttatggtctgagggcctccaggctcctcttctggctgtctacccctccacacccatagctccagtcatcacttccacagggatgactcagaagttccctctccgggagacccgtcccttacaggccacatccagtagcgctccagccattcagcagctccgcctggacgtcaagggcatgtccaaaaccgcgctcatgatcttcctactcccccatccctgagatttatcctgtggctgtggtgtcctgtggctactgtaacaaatgaccacaaacttggtggcttcaaacaaatttaatctctcatggttctgaaggccagatgtccaagatcacgatgacggcaaggccgcgctccctctggagactgtcggggaaaacctgcccctttcctcttcagcttcaggtggtggctgccatgccctggtgtttcctggcctgtgaccgcatcattccaatctctgcctccatcttcacgtggccttttctgtatgtgccggtctaatcttcctctgcttctctcttattttttgttttttgagacagagtctcactctgttgcccaggctggagtgcagtggtgtgatctcggctcactgcaaccgccacttcccaggttcaagcaattcccttaacttagccccctgagtagctgggattacaggcgtgcactcagcaaatttttgtatttttagtagagacgtggtttcaccatgttggctaggctggttgtgaactcctgggctcaagggatccaccagcctcagtctcccaaagtgctgggattacaggtgtgacccactgcgcttctccctataagagaggccttcctctgcctctctcttatagggatacttgtgatgccatgcaggacctgcccagataatccaggataaccttctctccaaatccttcccctgatcactcctacagatctcttccatagaaggtgacatttccaggctctaggaattaggacctgctctctctgggtggccgttgttcactccaccaccccaggtttccccatcctaccaaaagacacagcagcattgtgtcaactgcccaaactgaaaacctatgagttattctcgacctgacctttttcctgagcaagttctgtggatttaacttagcggtcacactgccaacttcaaccgaactccactgccaccaactcagtccaggccaccagttcttgtttaggtgactgccatgacccccattggtctctccctgcctcaactctgtcccctccatcctatatccccacactgtaaccagactgattatttatttatttatttattttttggggaaagaagcttgctctatcccccaggctggagtgcggtggcacaatctcagcttactgcaacctccgcctcccaggttcaaacgattctgcctcagcctcccaagtagctgagattacaggtgtctgccacaatgcctggctaatctttgtatttttagtagagacgggttttgtcatgttggccaggctggtctcaaactcctgacctcaagtgatccacctgccttggcctcccaaagtgctaggattacaggtgtgagccaccgcacctggccagactgatctttaaagaagtatacatgaacacagcactccatgacttaaaacccttaagaggactaccatttatctcaagataaaagaacaaaatcctcactgggcacagtggttcatgcctgtaatcactgctttgggaagccgaggtgggaagatcactttaggccaggagttcgagaccatccatgggcaacatggtgagaccgcatttctacaaaagataaaattagctgggtgtggtggtgcacgtctgtagtcccagctacttggagggtgaagtgggaggatcacttgagccctggagttcgaggctgcagtgagctatgacggtgccactgcactccagcctgggtgacggagtgggacctcatcaaaaacaaaaccgttattgtggctttgaggcctggatcataactacatcatttaatttggccaaaccggcccatttcaggtacccaaataccccacgtgctttcttgcttggctctgggactaatgtggttactggtgcagggtgagtggcaggtatcatgaaccacattgtggacctggagttgctaggaccttttctgccattacacagaaaaatcctccctgagaacacagccattggaggacacatggcagaggaagataagacaataaacagagacacataattatggccagcgtgggggctcacgcctgtaatcccaaaactttgggaggccgaggtgggcagatcacctaaggtcaggagttcgaggccagcctggccaacatggtgaaaccccgtctctactaaaaatacaaaaattagccgggcgtggtggcacgggcctgtagtcctagctactccagagggtgaggcaggagaattgcttgaacctgggaggcggaggttgcagtgagccaagatcgcgacactgcgcgacagagtgagtctttttgtctgaaaaaaaaaaaaaaaatatatatatatatatacacacacatacacacatatatatacacacacacatatatatatgaaatgaccaatacacatgtgaacatattcaacgcaataactgcggttaaacagcagtaaaatcccattatttatccatcagattgacaaagactgaagaactggagaagaagtggcgaaacgggctcgcagcgtcgcattccctaccccagcaggtgcgcccgcagcgtcgcactccctagcccggcaggtgcgcgatcacacacacaccctgcagggggacttcgaccggcacttccggtcccggaagggcatgcccttggaccccggaagtccgggcgggggcagagccgggtgcgctttgcgacagagccgtaaaggcgcgcgggaacatggggctgtacgctgcggtggcaggcgtgctggccggcgtggagagccgccagggctctatcaaggggctggtgtactccagcaacttccaggtagcgggcccgggcgccacaagtaggggtggggggtgaggaacccggggtggggtgggacgggcccggatggggtcgggaggtggggcccggcgaggagggccgggggagcccccgacccagcttgtctccctcggccacacagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctagcctcccagctgcctcgatttgtgcgtgtgaacactctcaagacctgctccgtttatgtagttatttcaagagacaaggtttctcctatcagggtcgggcttccaggtgagagcttagagccctggctgtcctcatctagggaggtgtctggggtactgggaagagaagtggttggatagttgtgactttgctctctgggctttgttcctacctttccagcagtttctccatctccaaggtttgttttcctcgcatcccttaaacatcgaactcctaggagccccatcctacattcttccggagctctccgttttttctctaactttagctcctgcctcccacctggtgattctcaccgcccagtgtagacttcccttttgcattcttccctccttaggttcacatgaatgcaccacagatgccacagtcgctgcattcatctttcctctcagactttacacttagtacatccccagtttaatctaacagatgtcaccgttttccacccatttggtcaagccagaaaccgagtcatcctaggtgcttccttcccctccctccaatcatttactcctccaccttgagcatctttctcagctccacttttttttttttttttttaggactgagtctcgctctgtcactctcaccgaggctggagtgcagtggcatgatcttggttcactacctccaaggttcatgcaatgctccttcctcagcctcctgcgtagctgggattagaggctcccaccaccatgtccagctaattattgtatttttagtagagatgaggtttcaccatgttgaccaggctggtctcaaactcctgacgtcaggtgatctgcccatcttggcctcccacagtgctgggattacaggcgtgagccacagtgcccggcctccactcctttctcttaattcccccggacactgcctaggttaagcactcatttcttattgggatgaccacaagaacttcccagactggtctctctgcttccagactgtctcactgcattttccttgaggttgactgtaggaagctctaaaggcagatctgatgcattactcctctgctaagccttttttttttttttttttttgagagagttttgctcttgtttcccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacagtgggcccaggagactggcacttagcataccaaggacctgcaccagcactggtctccgagttccctcagtttttattgattattattttcattatctcagcacaaggaatgcggtaggagagcagggtgataataaggagaaggtcagcaaaaaaacctgtgagcaaaggaatctgtgtcataattaagttcaaagggaggtactatgcctggatgtgcacgtaggccagatttatgtttccctccgcccaaacatctgtggagtaaagcataacaaggcagcattgctgccaacatgtctcgcctcccgccatagggtggtttttctcctatctcagaattgaacaaatgtacaatcgggttttataccgagacattcagttcccaggggcaggcaggagacagtgcccttcctctatctcaactgcaaggctttcctcttttactaatccacctcagcacagaccctttacgggtgtcgggctggggcacagcctctcatcccatgaggctatatttcagactatcacatggggagaaccttggacaatacctggctttccagggcagaggtccctgcagcttttcacagtacattgtgcctctggtttattgagactagagaacggcgaagacttttaccaagcatactgcttgtaaacgttttattaacaaggcatgtcctgcacagccctagatcctttaaaccttgattccatacaacacatgtttttgtgagctcaaatttggggcaaagtcacaaattaacagcatctcagccaaccaattgttcaaggtacaggtcaaaatggaatttcttatgtcttccctttctacacagacacagtaacagtctgatctctctttcttttccctacaggattgcaggcatgcagcaccatgcctggctaattttgtatttttagtagagacgggatttctccatgttggccaggctggtctcaaactcctgacctcaggtgatctgcccaccttggcctcccaaaatgctgggattacaggcatgaaccaccgcgcccggccatgctaagtcctttcttggctccattgtgctgtccctcctgcttcctctccaggtccatctgccacagtgctacgtgcaccagcgtgccagcaacagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacccggcccctgtgctctgcctgccaggccagctgtctcccagccatgctgctggacccccgccaggctcccatgtcatcgatgcctgtgccgccccaggcaataagaccagtcacttggctgctcttctgaagaaccaagggtgagtgccacaggaggaggaggaggaggacatggggtttgattttgtgcctttcagtgggtaataaaggctgaaaggatgactttcgcttaactctttcctgctgtaccaaagtagttcacggtatttgccccaagctaagctttccccactgcaggtgtgagatgtggatcccttagcccttggggcagagaccccaggccagttacctctgaccctgggccctttaaatataggccgtttcaatattgtgtgtcctggcttaacctgcatgttctggttgtctgtgtcagctgtgacaggcccttagctgctccgtgcatgctcagctcacccctgctctgccctctgccctaggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggtacagggcgggcgccagggtcgtggaggggggggatggggtgaactgctctcttacccagcattggggctgtttctcttgcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactctacgatagatcacagttttttattcttaatgtcacaagcaggagaaaaatctcacattcatactaaaaattccaactagactcaacaggaatgaagtctctatttgtaatggaaagtcccagcctcccgctgccgtccagtgtgtgtactgtacacatccacactcactctcactcagggttcccggaccggctgtcctgcctgcggaactgaggtaaacaagctcaggtactgacactaggagggtctaccttacataaggtacaggtagaagcttgattgattgctaggcccaggcccacccagaccctccaatcctaacaggtatttaggcttgaggttcactccctcctcagctgcacacgcagccaggtataacactcgccctcagtcacaacggggagggggcaccggttacatctacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgtttaaatatttttttcttttaatttagacacacgcattcatacttctcccaaagaggttgggcgtgacagcaaggcgcttgggcctggggtatgtggtttcagaaggacggaaggaaaggatgggctgcagagggccctgtttgggaaaaataggattttaaaaatatggttcattaatttaggttttctaacatctactttgggtgacgtagcctccagtgaggtcagttaagtgggacagaaaccgcagagggaagaggtctttgcttcccctgggcccattctccctggctgccagcccttgaagtcagaacaccatgggaaaattcaggagtcggcacttgtagccgtcaagtggtgctactttccacattcaattagcgaggccccagaaaacttgaaacaggaagtccggcactaccaacatgccgccactcatacaactcaactcttcctccaaactcgattcaaagagcaatacacagagcgtcagacaaaggaacacaggacaaggcttgaaacatacaatcctggagaggcagacgagggcccaatggggccaaagggtagctgggcgaggaggcagctgaagcagcggtgggcatcctgcctgctccaagagcttctcccttcacccctggctctgccaggctaacagtcttgagccaccaagctctgaggggccaaactggcagagggttggagatgaaacattgattcaggcttggcaggaagaaaacggcaggagcagcacccactggggtctccaaggcaaagctagattcaagggcatttaaaaaggagggaatcctgcaaggaaccggtgagggacacagcagcaagaaatggggaaacagagtccccagaagggaccagaggaagagaaccacttctcacagctaagccaagcaagataaagctttagggataacccatttcccaaatcccatcaggtgcacaccaccgatccaggcgggctggaccctgccccctccagcgacgacggctctcggggaaaggtggaaggggcgcctgcctaagggtgcgctaagcgggagtcagggcagcggacactatgtacaggtccttagttctccagcctccccagtggaactgttcaagtagaggtcccgggctttggccctccgcatcctgcttccccttccctgaggcttgtgcttcctccagaagggaaagggccccagggctgccactgccccctggcggctgaagccagagatccggggtaggtttgctttacgcagctggaagggtccaaggctctttctagcacgtgccaaggtccagatttagggaaggggtggggggaacagggacaggggacaaaggctactttttgcgggtgtgctgccttcgggcctgcagtcgctgtcgagcccctggggtcttggatcccgcaccaatggaaaatgaaggggccgccgatcctggaaagattcaacaagacctcatcagggcagctgctacctgagactctggctctgggtgcccaaatctctggaaggccaggccagtaataaaacacagggtgcctcaatagggctttccccgctgcgtcagaaacactgtacgggaggagcctcctgaaatgcaaactcccagagtctcagagcgaggcccacgaatccatttttacctggcttcccatgggaggcaaacttccaccccggacagctcctctctgatctctgccatccaactcccatccctgggctgtgctgtactcctaacccgaaatgtctttcctgtgctgaacctgatcttcacggggcctcagagggccaggagcctgccaccccacccaacctctcctcagacagacgagcagggccacagggtggcttgctgcttaccgaacggtccaacaccaacaaagccttgggcgggtgctgaagatgccccaaaggagaggctgctgcccgatgtgcccactccaggcgcaggggtgttctgaccaaaggtgggggtggcggtgcctggaatgaagagaacagagagctggccagtgagcagagggcggaggcaggcgaggagccgggcaggagcctgtgctctgcagggcacttcccacgggaccctcagccccacttctgcttctggggcactcctccatcagcagctgagccagacaaccgagtcttcatgcctggtgccccagctcagcctgcttctcccacccgctaatggccacgccagggcagagaaaaagcccccctgccccgcagccacctcgtgggcctcctgaccatcgctgcagaggggagtactctggggcccccgcctcctagcgtacctgggttggctacctcctctgttcaggccttttccccctagccaccgtcccctcccctctgaagcctggtttgtccgtcctgtgtcttttgtgatgccccgtggtcccctcccttccccggccttgccctgactggctctggctgcctgcccgatgccctctctggcagcccctctgcagggatggctgctctcagggcttggctccggcccggacaaggggaagctccctgtgctcccacgctgcttccacacagtttctcttccttccctaaataccgtaactcaggttcaaatcactttaatctgccatgtcctcatgtcacctgtcaactgccaggtcactccctgattcacagaggacccttggctcactggcttcctccccatcaccactcacggtgacttcgccctgtgaggctgactgatggtcctctcagcccctcggccctgccacccccatgacctcctctccccgacccctgccaccactcctgcagccacactgtcaccacaactgctccggctcccgaatctcctgcaggcaccacccctcctgcagctgacttcacccgctctccactcctgcaccccctgagctgcatcggggcactgacccgctgcccctcctgctgtgcttgctggggtctccacagccgggtggcaccagctgtccgctgaccttagatctatacccagtgtcgctgggaaacacacgccatgctaactggcctcactttaacttcacaatcacaattttccagcccacaaactgcctggaaactgatcacactttttaatatgatgttcctttcccccactgtccaaaatgactatttcaaaagaccccttttttatacactttatcccgaccttccctctcccagattttctctcctacttcacgaagcaaacagaagccatgggatctacattcatcttccacacgggaggaaccatcactgcatccttctgcctgattctgcaatggttttcctgaacacttaagacccaaacacccaaccctggccacaaacaatccttgcctcttggcctccttccacaccactgctttagctcctgccctcctgccatgcttgtctttgttctgctcttcaacataccaaacatgtttctgcctctgggcctttgcatgcgccatcctgggcctgaaaggcatgtccacttgtgctgtgcccacccccaccccacccccatattcagcttacgcttgagacagtcttgctctgtcacctaggccagagtacagtgtggcatgatcttcgctcactgccacctccacctcctgggttgaaacattcttctgcctcagcctcccgagcagctgggattacaggtgggtaccaccatgcccggctaattttttggtatttttagtagagacagggtttcgccaagttgcccaggctggtcttgaactcctgtcctcaagtgatccaccctccttggcctcccaaaatattgggattacaagcatgagccactgcgcccaaccttcagcttacaattgttaagtactcagaaggcctttgaccagttaaatccacaatggctcctccagtcattactacgttagcaaaacatgtatcatgccctggcatctcactgagttctatattcagtgcctgtctcttcactgccacagcataagctccccgagaccacaggcttcacaggcacagcttttcagtgtccggcccgtagcccaagtccacgcccctccttacctccaaacacaggtttgctctcagttgtgctgcccacgttgaaggcaaacggtgtgctctggccggtggtgcccagggcgttctgacctaagccccctgtgaagggggtggaggtggctgtgctcccactctgtcctgctccaaagctgaaagctccggtggtggcgctggagcctggggtggccacgttgatcccaaagctcccactgccagcgggggctgccgaacccccaaacgtgaagggtgatggtgttgtgctgccaaacaccgagctgctgctcccgctgctggcggtctgggtggtggctccaaagccggagctggtggctgcaccgaaggagaagacagcagtggagccgccaaaggcgggctgtgagctggcgggagcgccgaaggcggaagccgtggctttcaatccaaacgccgagtgcgtggcaccgccaaaggtaggctggatgggcgtaggcacgtgcgcaggcacgatcttgatcgtggacgcaggtgcaggtgtgggtgcagtagccggggccggggctgcagagtttccaaaagtgaaagagctgccaaagctgggggtaagggctggcttggcggcccccggtggctgcccctcagcggccccaaatgcgggctgggggttggctcccggatatgatgggagcggggacttggcgcttgagccaaagggaatgttgaacgtgggggtgctcgtgttactgaacgtcagagtgggctggctgctggtggccggggcggaggtggcgagggtgctgccaaaaccactaaagtcggcagcgctgctgctggtggccgttggcacggcagtgggcagggactggctgaaggtggtgactgtggtggttgtgggcaaggcaggaggtttgccaaactggaatatggagcccatggccggggtgaagctggcagcagaggcctggggcgccccgaagaggaaaggctgtgaggcggcagtggcggtgctggtcgtggtactcacactgctgctgctcacactgtttatgccaaagccaaacgcaggcttcgaagcagagtctgtggatggactggcagaggtgatgggagccacagcagaggtggcgctggccaggccagtgaagagcggggcagttgtggtgggagcagtggcgggagtagttgtctgcttgaagaagggagcaggcaagggcacagatgcaggtggccccatgctgctaaagacaggctggaaggtcggggctgtggtgctggtggtcgtggggagggaggagctggagggcgctgtggctgtgactgaagggccaggcggtgtggggccttccttctcactcttgggtggagccgtgaaaatgggcttgaacatgggagatgctgaagatgcagcaggggcggcagggctggaaggtgaggtgttctgtgttccaaacaggaagctttgcttgggggcgggggacggggcagatgtggcttggggtttggtagccgtctctgcttgaagggttggaggtgccttggtgtcagtggctggtaccatggatggagcagggatcagccccagcaaagtggtcgggggtttggagtcaaaggaggggctggggagcagccctggcggccctgactgtgataaacccagcgggggtaggaggctgggtgtctttggaggtgagagggcctcagtggttgctgctccagcagattctggaagaagaatagaaaatgtgaaattggaataaacacttcaaagatgatggtattcagtatttcagcgtcctccccatgcctaccacagagcctgggatccaagagtcagtcaataaactcagctaagtctacactacaggcctgtacagtaaatcaaggaagtgttcattatttccacctcacagatcatcagacagaaggggataaaatggggcctaaatgggggcctaatgtgtagagactaagacagtccaattgtctgaactctgaagttcacgtatgaatctagatatactttatttgcctactaagctcacctgccaggcgctaagagcacacaactatgaatggggaagtctctgcccttgagcagggagggtgcgtacgaaccccaggttaccgtctgataaagaggtgtgcgcgcgcagtgccgtgaaggcctgggccgggaacaccagcagccctcaaagtgctggagggaaaggaagcagtgttgttctggaccagtagttctgacaggcaaggatatcctgaccacgccaccacattcacacttcagaggtgctgcaccgggaagatcattctcatctgacagatgaggaaggcgaggctcagggcagctaagccaggcttcagatcctgagcgtcgcagcaccccttctctaacacttcctgatgtgggctccggcgctgttaaacgtaggcccgctccggtgtgctgagccagggtgcgttcggcctgcagagcaatctccagcgactgacaggcacgacgcccttattccaacccaagccggggatgctgctcagaaggctggatccacggccccactccagctcacctgggcagggtggcaggctcgggggagtctgcatcttcttcaagctctctaacagtgggttggtgcttggggccaggagggaggtgggtggggaggcagttgcagcagcaggcagggtaaaggtaaatgaaggctgagtggtaggtggggtctcagtgacagagttcgaggcagcatctaagaaagaaagaaaggtgaagcagtcctggcttgtctgggacttctttccacatgcctgtcggagagcaggctctcagcacagctcatggaggaatgtctgccctaaattgcagtggtccctgctgtccagttcccgtgaagaccaacacggatatctcaggtgagaaagaccacaagaaaacatggaactctacttcggattttcccagagaaacccatttttccaaacaccaaaataaaaccaaagaaaacagacacctgaaacctctcgagagtgcaacgatctgtgctccttaccactcttgtcctccaaggcctggttgaaccactgtaatgaagccttcttctctaagtctaggtcctcggcagtgatcgaatagccaagctggggaggtggaggctaccaaagagaaaaagaagaagtcaggccaatcagaaaaaacgggaaggctgggcgtggtggctaacgccggtaatctcagcactctgggaggccaagccagctggatcacttgaggtcaggagtttgaggctggcctggccaacatggtgaaaccccatctctactaaaaatacaaaaaattagtcaggcgtggtagcaagcgcctgtaatcccagctacttgggaggctgaggcaggagaattgcttgaactcaggaggcagaggttacggttagccaaaatcgagccactgaactccagcctgggtgacagagggatgttgtctcaaaaaacaaaaacaaaaataagttagaaaaaaaaccagaagaaacttgtccttagcgttcctaagacttaggagagctaagccggggagggcaggagtagatggacaagaccataccaaggtcagctgttcccctcgccgagaaggcagcagctgaactttccgcttacgctgcccagagctgccaggtgtagactgagaattcgagttttgtttcttccttggggttgtatctgcagctaaagaaagaaatcaagactcgtttgcttccttccctcttccagaaatggatggttgtgtctacccacttcgcatttcacactgagttttcaatgatggtatctctgaaaagattcaatcttctatggtttggttgcttggatggtgtttgtaagattaaggcgcgcacacaaaccgcttactgtgcagtaattactgggatcacccacaggtgactcaaactgagcttacctctatccaatcgttagcccccatctgtagcctttctccctcatcagactataaacttctgaaggagaggaaatctctctctttgtatctaacatgccttagacatagcaatgctcaagaccttttttcaataggtattaatctctacatcctccacaaatacctccaccaccaacagcagcccctcatcctggctcagcaacctacccttttctccctgggactccttgtctgctgccaatggagttgaagaactggaatgatgacacagctcttcttctctgttgggaaaaaaggaacaatttagtctagaaagacttcttggctgaagtattaaataatttctcacaccctcctaactaccaagtggccaacatctaaaacaaccatcatttaagatctcagtatgccaggataaaaaaagtcaacaggaaattccaacagaatgaagggaggctgttcacagaggccatgaagacagtttttgtcttaaaacaagcacaaacaataatcttcaaaccttacttacaacctaccaagtccctgggagttctagacacagatgtgatccctgagggagtggcattccagccaactgcaagcacctaggggatcagctcgagtcaagaacctgaaggcgactgcccgctgacttgactctctctgctctccactctgcatggcctctgtgcttgcacccgatccctcatgctggagtgggaggcgacagccagaggccactggagtcagtatccaagactgtagggatgatagttgttcaggtgggtgctgcattgtccctctcagggacttagtttctttgattctccaagtcacagcagcacaaagcctaagagccaggttcgtttcccacctttcctcacccccttctgtccacgtagcaaatgaaaactgcaggagaatgccgaataccttattttctttgctggcctctccggtgtctgggagcgggatgaggctgggctagagaagggtgatgaactggggccatttctcttccagag

SEQ ID NO: 8793 - DNA, 35007 bp, Homo sapiens
taaacaggatcttgctctgttgcccagactggagtgaagtggcacgactatagcccactgcagccttgaactccgggctcaagtgatcctcccgcttcagcctctccagtagctgaaactacaggcacacgccaccacgcccagctaatttttatttttattttgtagagatggggtttcactatgttgccccggctggtctaaaattcctggcctcaagcgatcctcctgcctccgccttccgaagtgctgggattataggcttgagtcaccaccgtgcccagcatacatctgctttctgaatatttgagaggcggaaggcacaaggcgtgacaattgatgggatttgggatgtaaagagcaagagaggactcaagcacagtcgcctcgaggtttctagccccggctgctgtcaccaaccactctcaggaaggtaggcagaaggttacgcaggagaaaccgtaggggtagttctgaggccctggaaggggtagttctgaggcccccgggggtgcggagctgcaggtccagggaggagtggtgaggctggaggaaggtgaggctggaggaggaggttcaggaggctctgaggtaaagatggaggctggggccttgggagtcgaggagtttacccaagacgaagcatctgtgtggaagaaaagataaggctgggcgcagtggctcacgcctgtaaaccaagcgctttgggaggccgaggtgggcggatcatctgtggtcaggagttcgagaccagcctggtcaatatggtgaaaccccttctctactaaaaatacaaatattagccgggtacagtgcacctgtaatcccagctactcgggaggctgaggcacaaggatcacttgaacccgagaggcagaggttacagtgagccgagatcatgccactgcactccagcctgggtgacagagcaagactccatctccaaaagaaaaagaaactataaacatcattgaaagaaactaaagaagacctaaataaatggaaggaaatcatgttcatggattaaaagacttaatattattaaaatttcattacttcagaagtgatctacagattcaacacaatccctatcaaaatcccagctgtggctgggtgtggcggctcacttctgtaatcctggcacttcaagagccaaggtgggaggattgcttgagccgagaaatttgagaccagcctggcaacatgatctctacaaaaaatatagaaattagccaggcgttgtggtgccagcctgtagtcccagctacccaggaggctgaggaaggaggatcgcttgagcccaggagtttgaggctgcagtgggctatgatcacatcactgctctccggcctgcgcaacagtgcaaggtcatgtctcaaaaaaaaaatcccagctggctttttttttttttttgagatggagtcttgctctgttgcccatgctggagtgcagtggcggacgatcagcctcagggcaggccatctagaagaattaccaaaaacaccaacccatttgtctctctataaagtgctgacatttgtgctctgcaacgtacagctgagagagcacaaaacttgtctgactcagcacagtctaggaagtcaagcagctcaatcttgaacaggacagtggtgtttggggggatcaagggaggggagcccagcgttccataggcgtagttcggtttgaacagaaacctggccagctctcctctctgcatgctcagaaggcccagctccatgccccacaatgtaatatctgtaagaagggacaaagaaggtgggtgaagcttgctcagtatcctgcttaatgctatcagtttcttccccctctaagtcagcagtactctggcctccatgtctccctcacacagttccctcttcctgcaatgtcttcctcctgagcctgtgcccagcttctagtgatagaaattttattcaaacttctgggctcagttcaaatgccccctcttccaggaagccttccctgaacttcccagctagaattaatcatgccttcattaagcacacccacaacactgctttcacctcccaggcactcatccgattctaccaagtgagctgagtgcaggtcagtctcctctactacattgtgaggtccttaagggtggagatgttctaatcttctgagtacaacctctcttttcaccatgtattgtgggaagtaagcattcgtcgatttttacttaataaatgaacaaagaaacattcccagtggtgagttaagtcagagtgcaaagattataccttgcccattaagccatctcccaaatgcctaggtctcaaggggagagaacatggctgttttaccaaaacccagcctcagcaaagtcaattcaaagaacctgcgctctgagcagtcttcccagcctgaggcatggtgcctcatctcgctcctaaacaatcccttcttctccagctcctactctgaatttaccctctccaagtttcattagccgaggagttttcctaaagtaattagaatcgaagggtctgtccaagtgttccaggtatccatactatttcactagaatagaggaaagaatgtaaggaaaatggacccaaaacacccacgcctccataatatcgagtctctcatgatcacacagaaacaatgcgatcagatgagcttaagctgcccgacaccacgaggtacaggaataaatctctctgcattttaggagcctgcccttcggctcagaggttcaagagcttcatggaagcatcacgcaaaggggacataggggtccttagctttcctcttaaaaaaactaattcatggcagaagcagcggctcacgcttgtaatcccagctactggggaggctgaggtgggaggatcacttgggaccaggagtctgagaccagcctgggcaacatagaaagtgccccatctctacaaaaatattaaaaattagccgggcatggtggattgcgcctgtaaatctcttatttgggaggctgaggctggagaatcacttgagcccaggaagcagaggctgcagtgagctatgttcgcaccactgcactccagcctggggaactgagcgagaccccgtttcaaaaacaaaaatccacttcaaacaaagcatttccaaccccattaaatgctttttgaaaatgaggcctctctcttcccaacagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattccattctggggccacgaggaggcactcatcgtttcgttccaaccgccgccaacggccctggccctcgcgagctctggaactacagaggtcgcacggtgagttgccaggtgtggcccgtaatcggagcgcacaaaacatgatgggacacgtaacgggaccacacagggcacattgggcacttgcaggggcgcgaggtggcggcacgtaatgggagcgcgctgagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctgggtacgtaatgagagcgagcgggaaatgatggggcacctaacgagcacgcagagcatgatggggcacgggtgcgaggtggggcgcacagtgggagcgcgtggggcatgatgggacacatggcgaggccgtcagggcacaggggaagcacttttggaacacgtgagtgacagggctgccgcccttgaaggagccctcggagtggctgcgtggtggggcacgtggggcaggttcaggaaaaaggatgcagcatgtgattgcagggcaacctggtgaggacacgagagccacctgccaccagcagggttcagggctcccagctgtgggttacttccaccttctttcactttccctcttccattgtattctagagaatttaggcccagacaagacactgattgattgattgattgattgattgacagaggctcgctctgagcccaggctggagttcagtgatggatctcagctcactgcagccgccacctcctgggctcaagagatcctcctgcctcggcctcccaagtagctgggattacagacgtgcaccaccaggcccagctaatttattttttagtttttaatttgctggtaagatggtttgtagctttgttgcctaggctggtcttgaactcctggcttcaagcgatcctccagtcttgacctcccaaagtgctgggattataggcgtaggctacagccaactttcaatactgccccattgggggttacgtttccaacacatgaaattaggaggatacattcaaaccacagcagtatattatgaccataatattcattaactgtgtaacaggctgggcgcggtggctcacacctgtaatcccagcactttgggagaccagagtgggtagatcactcgaggtcaggagtttgagaccagcctggcccacatgatgaaaccgcctctctactaaaaatacaaaaaattagccggtgtggtggcaggcgcctgtaacctcagctacttgggaggctgaggcaggagaatcacttgaatccgggaggtggaggtggcagtgagcctgattgcaccactgcactccagcctgggcaacaagagcaaaactctgtctcaataaacaaacaaacaaacaaaacctgtataacagagtgtcattgaatttctaaacgttgaaagacttcacattaaaaaaaaactcacaatttaatattattgagtgaaagaaaccagacacaaaagggtacattctatatgatgctgtttatgtgacattcaaaaacaggccacatgacaacatggtaataaggacagtggctgtccttgttaggagttatgactggaaggaggcaggagggagctttctggaaacactgtacatcttgctcttgagagtgcacgtatatacatcaagtgtttatcaagctgtgtggttaagatttgcacacttgtatatgttatacctcgatttaaaaaatctaaataagtaaataaagataccttcaaatcttttaaaaaaaaaaaaaaaagaggccaggttcggcggctcacacctgtaatcccagcactttgggaggctgaggtaggaggattgcttgaggccaggagttcaaaaccagcccaggcaacaaagtgagacccctgtctctactaaagtaaataaaacaataaaataaaaaaaaaaattcgagagatcgaaccatcatctgccagtttgtattagaaaaaaagagagagagaaggaagactgcgtgcaataaggctcatgcctgtaatcccagcactttgggaggccaaggtgggaggattgcttgagcccagaagttgaagaccagcctgggcaacaaagcaagacccggtatctacaaaaaaaattttaaaaattagcttggcatggtggcacgtgcctgtagtcccagctactcaggcagctaaggtaggaggatggcttgagcctaggagttggaggctgcagtgagctgtgaccacgccactgcactccagcctgggcaacagagcaagacactgtcttcccctgccccccagccccccaccccccccaaaaaaggatataagagcaagagattgagattcagaaagaactgtttcccagcacctgtctgctcctgtcggggtcgtgaggtgtggacagtgtgcctagtccctctgtttctgcccctcctccacagtggccaaggccagcacttgaatgttatcagagcaggcccaacaaaggctgcctccccagtcctgtgatgtaacccagtttccacctgattctggtgaccttggggacacaggggtgttgctggggaaggggaggagagaaggggcagagaccaggcagtggtgcaggcgtccagctgcacttcccacttctgactctgtgcctgctgttccctgctgggaagaagaaaagccagtgatgctggcttgaggccatagtgggaggcccagtggatcctgagaagctaggtattccaatgtcgggctctcgctgggggcttctggtgcttcttctgtctcactgacaagctttcataggggagcaggtgggagatcagggtagaggccttgtaggttccaggctctctagaattacctgggagtgtcacctataagtgtagagttctgggtctcactggagaccccctgaagcagatcctttgaaggtgggcctctagaatctctattacacctatgctttcaacagtttcctgaaagtttgggaactgatctagaaggtggggagcttgcctaggttttgctgttcagttctaggtccggatgcatgctggggctggaccttgcattattagtgtcactgcaaatgaccctgcagatggcccctttcatgcttgtctccaaatttgagtaaaaaatgtagacacacacacacacacacacacacacacacacacacgtatcttcaagggaccagttttttcactgcagtcttttgttttacagctgtggaaactgaggcccaaggtcatgtgggttaggactgggatccaggactcaaagtgtttcttataaaattctggtgctccttagggttgagggtggtgggtgagtgctggacagggggaggggagtggacaggactgaggtcggatgcctgtgtttcagcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggtggggagtgagggtgcaggcggggcggcggggcccgcggggactggatcctgtgctctctggcgctatcaactggcaccaaaacggatccagctatcctcgatttccctgcagccctgccctggcgcattcattccttagtgtttgagcggcagctaaacccaggtgctggggattgaagctacacgcacaggatgggagctccctggtgtcacgtgctcaccccttcgtgttttttgtttgcagttctggtttgtttctttttctttttttctttctctctctcccgcccccttcccttcctctctctctctctccccctccctcgcccgccccccctttctttttcttctttctttttggagacagcgtctcactctgttgcccaggctggagtgcagtggtgtgatcatggctcactgcagcctccaactcctaggctcaagcaatccacccacctcagcctcccgagcagctgggactacaggtgcacaccaccatgcccagctcattttttatattttgtagaaatggggtctggttatgttgcccaggctggtgttgaattccttggcctccaacgatcttcctgcctgggcctcccaaagtgctggaattataggcatgcaccactgccctacgccccttgtttgtgtctggacactcccctgtttgcactctctggtgcatgagagtggggacttcattttgtcccctggtgtatttcagtgcctggagccatgcctggcacattgtaaatgtccaaaatgctgaatcagtgaattcctgcctttataggccatcaccaaacctagcagatcattctttaagatgagtaataataatacctgactgggtgttatatatataaaacacctgttataaaacacgtgactgggtggcttatgcctataataacagcactttgggaggccgaggtgggtggatcacttgagtccaggagtttgagaccagcctgggcaacatagtgagaccctgcctctacaaaagtttcaaaattagcctggttggccaggcgcagtggccactcctgtaatcccagcataaagctggagggagcatgggtgggggcgagatagggccagcgaggtaagctgcggctggggcatggagaggccagtgtgacccgggaatggatttggagtttattcacaggatgagggagaaaggcgggggctggagtgttttaagccagtgatgacatgctcagatctctctggcagaggggagctttgagggtgaggcaaaaggacagtgagagatgaaggtgccaggacctaagttggtgggaactgggacaaaggcctggggcagaccaaagacaaatttcaaacagaaaaaaaccctgacaactgtgtgtggcaaggagggtgagggatggggaggttgactccagctctgtaattcccccttgcacagaggaagtgatcgcaggggaggatccggcgtgggcaggtggagcgggaggtgcctggggatgtgcagtcgggttgaggggtgtgcagaccaggacagcggtggggctcagggcaagaggtgtggagggtccttcctcttggtggtcactgaagtcccctttggtggagaagaccaacccaggagagtctacatagtgataagggaagacactgatgatgaccccaaggggtaccaggcttaaaatctggattgagagagagagagccctgaaaaaggaatagaaagaatcctcagagcaggaacaccggctgagtgtggcctcccggaaatcagagagacagactgaaggaggagatcacgtgtgtgaaatgtctctgaggactgaaaagtgttaaatgtagcagtaagaactgattatcttggcaagagcaggtttaggggagtatggaaggtggaagccaactgcaggtgaggaagccgagtttatgttttattagttgatgggaaggagggagggaacaggctgggagattgtctgtcctttgtagttaggatccagcagctcagcttgggtccctgttttagatttgggcttaatttttttttttttggtagagacagggtctcactattttgtccaggctggactcaaactcctggcctcaagtgatcctcccgtctcggcctcccaaagtgctgggattccaggcatgagccactgttcccggccagatttgggttttgatgatcccgaggctcttctctgttgcaacacagaatacaactaaattgcactcctttattgccctctttaaggtgttcccgttgcctcctgtttattgagatcttgagatgctcgattgatgggtgcattgatttgcataacttagttcttctcacggggaaggaatgagtcccgtctgtctgcctggggagggtgacattggaatgctgttcttaggcctctgtgagatgttctgatgcctcattctccagagcaaggactctgtccgtttatgccagcaagtgcttgattctttacccaactcccttcctgaaagccccttgcagctctctggtgcttgggcacgatccaagccaaaaattctgtacattgcatgggtataaaccgacgggggctctggtcaagtcatggagtagatggtggtccaggagtcctggttggcacccccaaggctaggtcagatttggggcccgggcagtccaggagaagtgcatttatgtcagcttggggaggtcgcaaatccgtgctgtgtccaagcccaccaggaatggattcaggtgtttataggtgtggggattcaccaggttaaacccaggcccgtgtgagcaccactggccctagaattagcctcacctggcgccggcctttttgtgatggctcctgattaaatacccactaattctggatctgctggtgaccacagagttcacctgatgggtcccctacaggcagcattcaatccaggaagtgccagcatcacatggtgacttctggtagctgtaacatttagtgactgtctccatgtcatgcacaggggtgacatcgagaccctcttatgcctgggaagttcctgctgtcaatgcagaatattctctttttttttttttttttttgagacggagtctcgctctgtcgcccaggctggagtgcagtgggcgatctcggctcactgcaagctccgcctcccaggttcacgccattctcctgcctcagcctcccgagtagctgggactacaggcgcccgctaccacgcccggctaattttttgtatttttagtagagacagggtttcactgtgttagccaggatggtttcgatctcctgacctcgtgatccgcccgcctcagcctcccagagtgttgggattacaggcgtgagccaccgcgcccggcccagaatattctttgaagaaaaaaaaaacattagagatgggatttcactgtgttgcccagtctggtctcaaattcctagcctcaagtgatcctcccatcttggcctcctaaagtgctgggattacaggcatgagccactgtgcccagcctagaatattcttttttttttttcttgagatggagtcttgctctgttgcccaggctggagtgctgtggcgcaatctcggctcactgcaacctcctcctcccaagttcatgccattctcctgactcagcctccggagtagctgggactacaggtgcccgccaccatgcccggctaattttttttgtatttttagtagagacagggtttcactgtgttagccaggatggtctcgatctcctgacctcgtgatcagccagcctcggcctcccaaagtgctgggattacaggcgtgagccaccgcgcccggcccttagaatattcttgaattatcttattttttatttttattttttgagacagagtctcactgtgacacccaggctggagtgcaatggcatgatctcagctcactgcaacatcaatctcccaggttcaagcgattctcgtgcctcagcctcccaagtagctgggactacaggtgtgtgccaccacacctggctaatttttgtattttcaatagaaatggggtttcaccatgttggccaggctagtctcaaactcctgacctcaagtgaagtcccacctcagtctcccaaagtgctggaattacaggcgtgagctactgcgcccagactattcttgaacaatttaacctgttttggactcaagggtacctgggtggctctggttcccgccctggtttccctgggagtgcttgtggccattgggatactcccaagaaggtgatccaaggagctgagaaggggagggatcagctgctcatggggccatggcctgttgcctccaggaggagctcgcagccctcttctctgagctgaagcaggagcagaagaaggtggatgagctcatcgccaaactggtgaaaaaccggacccgaatcgtcgtgagtgccccttccctctgcccctgcctgggaccggccaccttcactttcctgtagagctcagttctcattggtcctttacagaaaaccatgccttccatataaagccagaactcaaagcattccggggcggggtggggaaagcgcaaatcctctcaggggaattcaacccagttgtcgttaggactggctccaagttggcttttgccctctgtgtccttgagactgagataacccaggacttgagtctcgggggtaaacagctgaaagcatgggcgtgactcctccgcccctgtgccacctgtgtctgcttgaccttgccagcctgtcatggtgccctcccagtacctgggtgcgcaggcgtggagaggctggcagccctgggccctggctgatctcctgaactgagaggcacatggggctgggacgcatagtgccccggccctggaggtggctgtgaaacagaaacaggagccgagcaagatccagaagcacttggcctccctcatttaccctcctcacccttgcgcggcaggcggtatcagccctgcctggtggaggcggagctcagggttctgcagggagttctggctccctcacagcaaagcccgctcgcccagggccttcctgctttccttcagttgtggaactctgggatatgcacatttaatagctgaaataggcaaagtggggtgtggtggcgtgcatctgtaatcccagcaactcgggaggctgaggcgggaggattgcttgaggctgggaggtcaaggctacagtgagctatgatcgtgccactgcgctccagcctgggcaacagagtgagaccctgtctgttaaaaaaaaaattaaaaattaaaacaggccaaagcagagcctctccatttgaaatgggagctggggccaccctccccacggccaccgccagggctccccatgcatggggtgaactccctgcccggcgccaggccatgcagcctcccctgagactcaggtcccaggaccaacccggtcaggaaggccctggggacaccgaggccagccagacagagcctggcagctcggctgtgactctgcagtgagcagccctccctgtcccagaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctgggtgagtggacagggaggcgtcccatccccatacccgccagggccttccccttcccaacagtgccctggcttcccaccttctagccttaacctccctctctcttgccttccagaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttgggcatggtggcatgcgcctatagtccctgctactcataaggctgaggtgggaggattgcttgagcccaaagtttgatgctgcagtgagtcatgatcatgctactgcatgatccagcctgggtgacagagcgagaccctgtctcagaaaacaaaacactagaggaggagcaggtgtctgggaggcctggcagaggggcacacgcctgatggctgagaagggcccaggacccgagtttgccaggcaagccgagggaacagtcctgtaaaagggggagtggcgtgcggactctggttatgagaagttcagggtggctggatgtaaggcaggatatcaggaggagtgggagctgggagaggtgggaaatggccagaagcaacatccaggagcaccaggcatcccttgcttaccgtcctcacccttgcgcagcaggcagtatcagccctgcctgaaacttgctctgcagattgtgggaagagagcggatccatgttctagacccaacaaacgaacacgtgcagttcccaagccttcctcactccctgtttatgggagactccttgtttctcacatttcttttagtcttagagacaatttggtcaggagacatgggtttaaatgaaggcacagagcctgggcacagcagcttacacctgtaatcccagcactttggaaggccaaggcagaaggatgacttgaggtcaggagatcaagaccagcctggccaacatggtgaaaccctgtctctatgaaaaatacaaaaattagctgggtgtggtggcacatacctgtaatcccagctactcgggaggctgaggcacaagaatctcttgaacctgggaggtggaggttgcagtgagctgagattgctccactgcactccagcctgggtgacagagcaagactccatctcaaaaaaaaaagaaaagaaaacaagaaaaaaaaaagtccgggcatggtggctcatgcctataatcccagcactttatgctcaagtctgctttttttttttttttttttgagatggagtctcgctctgtcacccaggctggagtgcagtggcacgatctcagctcactgcaacctacacctctcaggttcaagtgatctcctgcctcagcctcccgagtagctgggattacaggtgtgcaccccatgctcagctaatttttttatttttaatatagatggggttttgccatgttgaccatgctggtctcgaactcctgacctcaaatgattcgcctgcctcggcctcccaaagtgctgggattacaggcgtgagccaccgtgcccagccttgagtctttatttttagagacaggatcttgctctgtcacccaggctggagcgcagtggtgcaactgtagctcactgcagccttgacctcccaggctcaagtgatcctcctgcctcagcctcctgagtagctgggacgacaagtgtctgctaccatacccagctaatatttaaatttttagtagagatgggatcttgctatgttacccaggctggtctgggcctcaagcaatcctcccaccttggcctcccaaagtgttgggattataggtgtgagccactgtgcttagcctcccataaccctttgattcacgatactcataggctaagtgggtcctggaagctccggggtagccttctaaccaagatgctggctcgggccactggaagtcaaactgggtgcacagaccagtgagagggcatgagggagcctagcaggggtgaacagcaaccctcagcctccccacagccctgcctctcctcctgcctctcctcggtctcctttgaggattcagcctctcgtcctcaccacttatggtctgagggcctccaggctcctcttctggctgtctacccctccacacccatagctccagtcatcacttccacagggatgactcagaagttccctctccgggagacccgtcccttacaggccacatccagtagcgctccagccattcagcagctccgcctggacgtcaagggcatgtccaaaaccgcgctcatgatcttcctactcccccatccctgagatttatcctgtggctgtggtgtcctgtggctactgtaacaaatgaccacaaacttggtggcttcaaacaaatttaatctctcatggttctgaaggccagatgtccaagatcacgatgatggcaaggccgcgctccctctggagactgtcggggaaaacctgcccctttcctcttcagcttcaggtggtggctgccatgccctggtgtttcctggcctgtgaccgcatcattccaatctctgcctccatcttcacgtggccttttctgtatgtgccggtctaatcttcctctgcttctctcttattttttgttttttgagacagagtctcactctgttgcccaggctggagtgcagtggtgtgatctcggctcactgcaaccgccacttcccaggttcaagcaattcccttaacttagccccctgagtagctgggattacaggcgtgcactcagcaaatttttgtatttttagtagagacgtggtttcaccatgttggctaggctggttgtgaactcctgggctcaagggatccaccagcctcagtctcccaaagtgctgggattacaggtgtgacccactgcgcttctccctataagagaggccttcctctgcctctctcttatagggatacttgtgatgccatgcaggacctgcccagataatccaggataaccttctctccaaatccttcccctgatcactcctacagatctcttccatagaaggtgacatttccaggctctaggaattaggacctgctctctctgggtggccgttgttcactccaccaccccaggtttccccatcctaccaaaagacacagcagcattgtgtcaactgcccaaactgaaaacctatgagttattctcgacctgtcctttttcctgagcaagttctgtggatttaacttagcggtcacactgccaacttcaaccgaactccactgccaccaactcagtccaggccaccagttcttgtttaggtgactgccatgacccccattggtctctccctgcctcaactctgtcccctccatcctatatccccacactgtaaccagactgattatttatttatttatttattttttggggaaagaagcttgctctatcccccaggctggagtgcggtggcacaatctcagcttactgcaacctccgcctcccaggttcaaacgattctgcctcagcctcccaagtagctgagattacaggtgtctgccacaatgcctggctaatctttgtatttttagtagagacgggttttgtcatgttggccaggctggtctcaaactcctgacctcaagtgatccacctgccttggcctcccaaagtgctaggattacaggtgtgagccaccgcacctggccagactgatctttaaagaagtatacatgaacacagcactccatgacttaaaacccttaagaggactaccatttatctcaagatgaaagaacaaaatcctcgctgggcacagtggttcatgcctgtaatcactgctttgggaagccgaggtgggaagatcactttaggccaggagttcgagaccatccatgggcaacatggtgagaccgcatttctacaaaagataaaattagctgggtgtggtggtgcacgtctgtagtcccagctacttggagggtgaagtgggaggatcacttgagccctggagttcgaggctgcagtgagctatgacggtgccactgcactccagcctgggtgacggagtgggacctcatcaaaagcaaaaacaaaaccgttattgtggctttgaggcctggatcataactacatcatttaatttggccaaaccggcccatttcaggtacccaaataccccgtgtgctttcttgcttggctctgggactaatgtggttactggtgcagggtgagtggcaggtatcatgaaccacattgtggacctggagttgctaggaccttttctgccattacacagaaaaatcctccctgagaacacagccattggaggacacatggcagaggaagataagacaataaacagagacacataattatggccagcgtgggggctcacgcctgtaatcccaaaactttgggaggccgaggtgggcagatcacctaaggtcaggagttcgaggccagcctggccaacatggtgaaaccccgtctctactaaaaatacaaaaattagccgggcgtggtggcacgggcctgtagtcctagctactccagagggtgaggcaggagaattgcttgaacctgggaggcggaggttgcagtgagccaagatcgcgacactgcgcgacagagtgagtctttttgtctgaaaaaaaaaaaaatatatatatatatatacacacatacacacataatacacacacacatatatatatgaaatgaccaatacacatgtgaacatattcaacgcaataactgcggttaaacagcagtaaaatcccattatttatccatcagattgacaaagactgaagaactggagaagaagtggcgaaacgggctcgcagcgtcgcattccctaccccagcaggtgcgcccgcagcgtcgcactccctagcccggcaggtgcgcgatcacacacacaccctgcagggggacttcgaccggcacttccggtcccggaagggcatgcccttggaccccggaagtccgggcgggggcagagccgggtgcgctttgcgacagagccgtaaaggcgcgcgggaacatggggctgtacgctgcggtggcaggcgtgctggccggcgtggagagccgccagggctctatcaaggggctggtgtactccagcaacttccaggtagcgggcccgcgcgccacaagtaggggtggggggtgaggaacccggggtggggtgggacgggcccggatggggtcgggaggtggggcccggcgaggagggccgggggagcccccgacccagcttgtctccctcggccacacagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgtgatgtggccactgcacttcagcctgggcgacagatctagaccccattctaaaaaaaaacaaaaaccccaaacccacacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctagcctcccagctgcctcgatttgtgcgtgtgaacactctcaagacctgctccgtttatgtagttatttcaagagacaaggtttctcctatcagggtcgggcttccaggtgagagcttagagccctggctgtcctcatctagggaggtgtctggggtactgggaagagaagtggttggatagttgtgactttgctctctgggctttgttcctacctttccagcagtttctccatctccaaggtttgttttcctcgcatcccttaaacatcgaactcctaggagccccatcctacattcttccggagctctccgttttttctctaactttagctcctgcctcccacctggtgattctcaccgcccagtgtagacttcccttttgcattcttccctccttaggttcacatgaatgcaccacagatgccacagtcgctgcattcatctttcctctcagactttacacttagtacatccccagtttaatctaacagatgtcaccgttttccacccatttggtcaagccagaaaccgagtcatcctaggtgcttccttcccctccctccaatcatttactcctccaccttgagcatctttctcagctccactccttttttttttttttttttaggactgagtctcgctctgtcactctcaccgaggctggagtgcagtggcatgatcttggttcactacctccaaggttcatgcaatgctccttcctcagcctcctgcgtagctgggattagaggctcccaccaccatgtccagctaattattgtatttttagtagagatgaggtttcaccatgttgaccaggctggtctcaaactcctgacgtcaggtgatctgcccatcttggcctcccacagtgctgggattacaggcgtgagccacagtgcccggcctccactcctttctcttaattcccccggacactgcctaggttaagcactcatttcttattgggatgaccacaagaacttcccagactggtctctctgcttccagactgtctcactgcattttccttgaggttgactgtaggaagctctaaaggcagatctgatgcattactcctctgctaagcctttttttttttttttttttttttgagagagttttgctcttgtttcccaggctggatggagtgccctggcgcgatcttggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacagtgggcccaggagactggcacttagcataccaaggacctgcaccagcactggtctccgagttccctcagtttttattgattattattttcattatctcagcacaaggaatgcggtaggagagcagggtgataataaggagaaggtcagcaaaaaaacatgtgagcaaaggaatctgtgtcataattaagttcaaagggaggtactatgcctggatgtgcacgtaggccagatttatgtttccctccgcccaaacatctgtggagtaaagcataacaaggcagcattgctgccaacatgtctcgcctcccgccatagggtggtttttctcctatctcagaattgaacaaatgtacaatcgggttttataccgagacattcagttcccaggggcaggcaggagacagtgcccttcctctatctcaactgcaaggctttcctcttttactaatccacctcagcacagaccctttacgggtgtcgggctggggcacagcctctcatcccatgaggctatatttcagactatcacatggggagaaccttggacaatacctggctttccagggcagaggtccctgcagcttttcacagtacattgtgcctctggtttattgagactagagaacggcgaagacttttaccaagcatactgcttgtaaacgttttattaacaaggcatgtcctgcacagccctagatcctttaaaccttgattccatacaacacatgtttttgtgagctcaaatttggggcaaagtcacaaattaacagcatctcagccaaccaattgttcaaggtacaggtcaaaatggaatttcttatgtcttccctttctacacagacacagtaacagtctgatctctctttcttttccctacaggattgcaggcatgcagcaccatgcctggctaattttgtatttttagtagagacgggatttctccatgttggccaggctggtctcaaactcctgacctcaggtgatctgcccaccttggcctcccaaaatgctgggattacaggcatgaaccaccgcgcccggccatgctaagtcctttcttggctccattgtgctgtccctcctgcttcctctccaggtccatctgccacagtgctacgtgcaccagcgtgccagcaacagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactccctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccataagtctggcttgacaacccattccctcaactgcggatcccggattcccttatcaccctgttgatttctccatagctgtggtaacatttgttgcatgaatggaccgttgaaatagggcctggcagggagaaattcaggaaatgatgaatgaatggttcttccctggcagcctcgatgacttacgagccctcaaggggaagcattttctcctggaccccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacccggcccctgtgttctgcctgccaggccagctgtctcccagccatgctgctggacccccgccaggctcccatgtcatggatgcctgtgccaccccaggcaataaagaccagtcacttggctgctcttctgaagaaccaagggtgagtgccacaggaggaggaggaggacatggggtttgattttgtgcctttcagtgggtaatgaaggctgaaaggatgactttcgcttaactctttcctgctgcaccaaagtagttcacggtatttgccccaagctaagctttccccactgcaggtgtgagatgtggatcccttagcccttggggcagagaccccaggccagttacctctgaccctgggccctttaaatataggctgtttcaatattgtgtgtcctggcttaacctgcatgttctggttgtctgtgtcagctgtgacaggcccttagctgctccatgcatgctcagctcacccctgctctgccctctgccctaggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggtacagggcgtgcgccagggtcgtggagggggggatggggtgaactgctctcttacccagcattggggctgtttctcttgcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacatttctctagctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaagaccctgggccctcaccgcaggcagcagtttgcgttttgaaaggttattgggtcccttcctcgggctgtgttcttgctggtgagcaaaagtgttgcctgcagaaataaaatgcagaacgtactctacgatagatcacagttttttattcttaatgtcacaagcaggagaaaaatctcacattcatactaaaaattccaactagactcaacaggaatgaagtctctatttgtaatggaaagtcccagcctcccgctgccgtccagtgcgtgtactgtacacatccacactcattctcactcagggttcccggaccggctgtcctgcctgcggaactgaggtaaactagctcaggtactgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccgccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgtttaaatatttttttcttttaatttagacacacgcattcatacttctcccaaagaggttgggcgtggcagcaaggcgcttgggcctggggtatgtggtttcagaaggacggaaggaaaggatgggctgcagagggccctgtttgggaaaaataggattttaaaaatatggttcattaatttaggttttctaacatctactttgggtgatgtagcctccagtgaggtcagttaagtgggacagaaacggcagagggaagaggtctttgcttcccctgggcccattctccctggctgccagcccttgaagtcagaacaccatgggaaaattcaggagtcggcacttgtagccgtcaagtggtgctactttccacattcaattagcgaggccccagaaaacttgaaacaggaagtccggcactaccaacatgccgccactcatacaactcaactcttcctccaaactcgattcaaagagcaatacacagagcgtcagacaaaggaacacaggacaaggcttgaaacatacaatcctggagaggcagacgagggcccaatggggccaaagggtagctgggcgaggaggcagctgaagcagcggtgggcatcctgcctgctccaagagcttctcccttcacccctggctctgccaggctaacagtcttgagccaccaagctctgaggggccaaactggcagagggttggagatgaaacattgattcaggcttggcaggaagaaaacggcaggagcagcacccactggggtctccaaggcaaagctagattcaagggcatttaaaaacgaaggaatcctgcaaggaactggtgagggacacagcagcaagaaatggggaaacagagtccccagaagggaccagaggaagagaaccacttctcacagctaagccaagcaagataaagctttacggatagcccatttcccaaatcccatcaggtgcacaccaccgatccaggcgggctggaccctgccccctccagcgacgacggtctcggggaaaggtggaaggggcgcctgcctaagggtgtgctaagcgggagtcagggcagcggacactatgtacaggtgtttccttagttctccagcctccccagtagaactgttcaagtagaggtcccgggctttggccctccgcatcctgcttccccttccctgaggcttgtgcttcctccagaagggaaagggccccagggctgccactgccccctggcggctgaagccagagatccggggtaggtttgctttacgcaactggaagggtccaaggctcttcctagcaggtgccaaggtccagatttagggaaggggtggggggaacagggacaggggacaaaggctactttttgcgggtgtgctgccttcgggcctgcagtcgctgtcgagcccctggggtcttggatcccgcaccaatggaaaatgaaagggccgccgatcctggaaagattcaacaagacctcatcagggcagctgctacctgagactctgactctgggtgcccaaatctctggaaggccaggccagtaataaaacacagggtgcctcaatagggctttccccgctgcatcagaaacactgtacgggagaagcctcctgaaatgcaaactcccagagagtctcagagcgaggcccaagaatccatttttacctggcttcccatgggaggcaaacttccaccccggacagctcctctctgatctctgccatccaactcccatccctgggttgtgctggactcctaacccgaaatgtctttcctgtgctgaacctgatcttcacggggcctcagaggaccaggaacctgccaccccgcccaacccctcctcagacagatgagcagggccacagggtggcttgctgcttaccgaaaggtgcaacaccaacaaagccttgggcgggtgctgaggatgccccaaaggagaggctgctgcctgatgtgcccactccaggcgcaggggtgttcagaccaaaggtgggggtggcggtgcctggaatgaagagaacagagagctggccagtgagcagagggcagaggcaagcgaggagccgggcaggagcctgtgctccgcagggcacttcccacgggaccctcagccccacttctgcttctggggcactcctccatcagcagctgagccagacaaccgagtcttcatgcctggtgccccagctcagcctgcttctcccacccgctaatggccacgccagggcagagaaaaagcccccctgccccgcagccacctcgtgggcctcctgaccatcgctgcagaggggagtactctggggcccccgcctcctagcgtacctgggttggctacctcctctgttcaggccttttaccccagccaccgtcccctcccctctgaagcctggtttgtccgtcccgcgtcttttgtgatgccccgtggtcccctcccttccccggccttgccctgactggctctggctgcctgcccgaggccctctctggcagcccctctgcagggatggctgctctcagggcttggcctccggcccggacaagaggaagctccctgtgctcccacgctgcttccacactgtttctcttccttccctaaataccgtaactcaagttcagatcactttaatctgccatgtcctcatgtcacctgtcaactgccaggtcactccctgattcacagaggacccttggctcactggcttccttcccatcaccactcacggtgacttcgccctgtgaggctgactgatggtcctctcagcccctcaaccctgccacccccatgacctcctctccccgacccctgccaccactcctgcagccacactgtcaccacaactgctccggctcccgaatctcctgtaggcaccacccctcctgcagctgacttcacccgctctccactcctgcaccccctgagctgcatcggggcactgacccgctgcccctcctgctgtgcttgctggggtctccatggccgggtggcaccagctgtccgctgaccttaggtctacacccacagtgtcgctgggaaacacatgccatgctaactggcctcactttaacttcacaatcacaattttccagcccacaaactgcctggaaactgatcacactttttaatatgatgttcctttcccccactgtccaaaatgactatttcaaaagacccctttttttatacactttatcctgaccctctctctcccagattttctctacttcacgaagcaaacagaagccatgggatctacattcatcttccacatgggaggaaccatcactgcatccttctgcctgattctgcaatggttttcctgaacacttaagacccaaacacccaaccctggccacaaacaatccttgcctcttggcctccttccacaccactgctttagctcctgccctcctgccatgcttgtctttgttctgctcttcaacataccaaacatgtttctgcctctgggcctttgcatgcgccatcctgggcctgaaagtcatgtccacttgtgctgtgcccacccccatattcagcttacggtttgttttttgagacagagtcttgctctgtcacccaggccggagtacagtggcatgatcttggctcactgcaacctccaactcctgggttcaaaccattcttgtgcctcagcctcctgagtagctgggattacaggtgggtaccaccacgcccggctaattttttggtatttttagtagagacagggtttcgccaagttgtccaggctagtcttgaactcctggcctcaagtgatgcaccctccttggcctcccaaaatattgggattacaagcgtgagccactgcgcccaaccttcagcttacaattgttaactactcagaaggcctttgaccagttaaatccacaatggctcctccagtcattactacgttagcaaaacatgtatcgttccctggcatctcactgagttctatattcagtgcctgtctcttcactgccacagcataagctccccgagaccacaggcttcgcaggcacagcttttcagtgtccggcccggtagcccaagtccacgcccctccttacctccaaacacaggtttgctctcagttgtgctgctcacgttgaaggcaaacggtgtgctctggccggtggtgcccagggcgttctgacctaagccccctgcgaagggggtggaggtggctgtgctcccactctgtcctgctccaaagctgaaagctccggtggtggtgctggagcctggggtggccacattgatcccaaagctcccactgccagcgggggctgccgaacccccaaacgtgaagggtgatggtgttgtgctgccaaacaccgagctgctgctcccgctgctggcggtctgggtggtggctccaaagccggagctggtggctgcaccgaagaagacagcagtggagccgccaaaggcgggctgtgagctggcgggagcgccgaaggccgaagccgtggctttcaacccaaacgccgagtgcgtggcaccgccaaagataggatggatgggcgtaggcacgtacgcaggcacgaccttgatcatggacggaggtgcaggtgtgggtgcagcagccggggctgcagagtttccaaaagtgaaagagctgccaaagctgggggcaagggccggcttggcggcccccggtggctgcccctcagcggccccaaatgcgggctgggggttggctcccggatatgatgggagcggggacttggcgcttgagccaaagggaatgttgaacgtgggggtgctcgtgttactgaacgtcagagtgggctggctgctggtggccggggcggaggtggcgagggtgctgccaaaaccactaaagtcggcagcgctgctgctggtggccgttggcacggcagtgtgcagggactggctgaaggtggtgactgtggtggttgtgggcaaggcaggaggtttgccaaactggaatatggagcccatggccggggtgaagctggcagcagaggcctggggcgccccgaagaggaaaggctgtgaggcggcagtggcggtgctggtcgtggtactcacactgctgctgctcacactgtttatgccaaagccaaacgcaggcttcgaagcagagtctgtggatggactggcagaggtgatgggagccacagcagaggtggcgctggccaggccagtgaagagcggggcagttgtggtgggagcagtggcgggagtagttgtctgcttgaagaagggagcaggcaagggcacagatgcaggtggccccatgctgctaaagacaggctggaaggtcggggctgtggtgctggtggtcgtggggagggaggagctggagggcgctgtggctgtgactgaagggccaggcggtgtggggccttccttctcactcttgggtggagccgtgaaaatgggcttgaacatgggaggtgctgaagatgcagcaggggcggcagggctggaaggtgaggtgttctgtgttccaaacaggaagctttgcttgggggcgggggacggggcagatgtggcttggggtttggtagccgtctctgcctgaagggttggaggtgccttggtgtcagtggctggtaccatggatggagcagggatcagccccagcaaagtggtcgggggtttggagtcaaaggaggggctggggagcagccctggcggccctgactgtgataaacccagcgggggtaggaggctgggtgtctttggaggtgagagggcctcagtggttgctgctccagcagattctggaagaagaatagaaaatgtgaaattggaataaacacttcaaagatgatggtattcagtatttcagtgtcctccccacgcctaccacagagcctgggatccaagagtcagtcaataaactcagctaagtctacactacaggcctgtacagtaaatcaaggaagtgttatttctacctcacagatcatcagacagaaggggataaaatggggcctaaatgggggcctaatgtgtagagactaagacagtccaattgtctgaactctgaagttcacgtatgaatctagatatactttatttgcctactaagctcacctgccaggcgctaagagcacacaactatgaatggggaagtctctgcccttgagcagggagggtgcgtacgaaccccaggttaccgtctgataaagaggtgtgcgcgcgcagtgccgtgaaggcctgggccgggaacaccagcagccctcgaagtgctggagggaaaggaagcagtgctgttctggaccagtggttctgacaggcaaggatatcctgaccacgccaccacattcacacttcagaggtgccgcacagggaagatcattctcatctgacagatgaggaaggcgaggctcagggcagctacgagccaggcttcagatcctgagcgtcgcagcaccccttctctaacacttcctgatgcgggctctggcgctgttaaacgtgggcccgctccggtgtgctgagccagggtgcgttcggcctgcagagcaatctccagcgactgacaggcacgacgcccttattccaactcaagccggggatgctgctcagaaggctggatccacggccccactccagctcacctgggcagggtggcaggctcgggggagtctgcatcttcttcaagctctctaacagtgggttggtgcttggggccaggagggaggtgggtggggaggcaggtgcagcagcaggcagggtaaaggtaaatgaaggctgagtgataggtggggtctcagtgacagagttcgaggcagcatctaagaaagaaagaaaggtgaagcagtcctggcttgtctgggacttctttccacatgcctgtcggagagcaggctctcagcacagctcatggaggaatgcctgccctcaattgcagtggtccctgctgtccagttcccgtgaagaccaacacggatatctcaggtgagaaagaccacaagaaaacatggaaccctacttgggattttcccagagaaacccattttttcaaacaccaaaataaaaccaaagaaaacagacacctgaaacctctccagtgtgcaacaatctgtgctccttaccgctcttgtcctccaaggcctggttgaaccactgtaatgaagccttcttctctaagtctaggtcctcggcagtgatcgaatagccaagctggggaggtggaggctaccaaagtgaaaaagaagaagtcaggccaatcagaaaaaacgggaaggctaggcatggtggctcacaccggtaatctcagcactttgggaggccaagccagctggatcacttgaggtcaggagtttgaggccggcctggccaacatggtgaaaccccatctctactaaaaacacaaaaaatcaaccaggcgtggtagcaagcacctgtaatcccagctacttgggaggctgaggcaggagaattgcttgaactcaggaggcagaggttacggttagccaaaatcgagccactgcactccagcctgggtgacagagggatgttgtctcaaaaaacaaaaacaaaaataaattagaaaaaaaatcagaagaaacttgtccttagcgttcctaatacttaggagagctaagccggggagggcaggagtagatggacaagaccataccaaggtcagctgttcccctcgccgagaaggcagcagctgaactttccgcttacgctgcccagagctgccaggtgtagactgagaattcgagttttgtttcttccttggggttgtatctgcagctaaagaaagaaatcaagactcgtttgcttccttccctcttccagaaatggatggttgtgtctacccacttcgcatttcacattgagttttcaatgggtatctctgaaaagattcaatcttctatggtttggttgcttggatggtgtttgcaagattaaggcgcgcacacaaaccgcttactgtgcagtaattactgggatcacccacaggtgactcaaactgagcttacctctatccaatcgttagtccctgtctgtagcctttctccctcatcagactataaacttctgaaggagaggaaatctctctctttgtatctaacatgccttagacatagcaatgctcaagaccttttttcaataggtattaatctctacatcctccacaaacacctccaccaccaacagcagcccctcctcctggctcagcaacctacccttttctccctgggactccctgtctgctgccaatggagttgaagaactggaatgatgacacagctcctcttctctgtcaggaaaaaaggaacaatttagtctagaaaggcttcttggctgaagtattaaataatttctcacaccctcctaactaccaagtggccaatgtctaaaacaaccatcatttaagatctcagtatgccaggataaaaaaagtcaacaggaaattccaacagaatgaagggaggctgttcacagaggccatgaagacagcttttgtcttaaaacaagcacaaaacaataatcttcaaaccttacttacaacctatcaagtccctgggagttctagacacagatgtgatccctgagggagtggcattccagccaactgcaagcacctagggggtcagctcgagtcaagaacctgaaggcgactgcccgctgacttgactctctctgctctccactctgcatggcctctgtgcttgcacccgatccctcatgctggagtgggaggcgacagccagaggccactggagtcagtatccaagactgtagggatgacagcacttcgggtgggtactgcattgtacctctcagggacttaagtttctttgattctccaagtcacagcagcacaaagcctaagagccaggttcgtttcccacctttcctcacccccgcctgtccacgcagcaaatgaaaactgcaggagaatgccaagtaccttattttctttgctggcctctccggtgtctgggagcgggaggaggctgggctagagaagggtgatgaactggggccatttctcttccagagctaaaaatcaagagggacatgactgagcctgctgataacttagcatctgaccctcaacacgacaaagtctcttttcaagtgactaaaaaaacattctttatggttaaatggttagtcatgcctgtaatcccagcatgctgggaggccaaggtgggaggatcgcttgagcccaggaatttgagcccagcctgggtaacatagcgagacccctgtctctacaaaaaaaactgaaaaatcagttgggtgtggtggtttgcatctgtggtcccaactactcaggatgctgcagtgagctgagattgccccactgcactccagcctg

SEQ ID NO: 8794 - DNA, 34488 bp, Homo sapiens
taatttttatttttattttgtagagatggggtttcactatgttgccccggctggtctaaaattcctggcctcaagcgatcctcctgcctccgccttccgaagtgctgggattataggcttgagtcaccaccgtgcccagcatacatctgctttctgaatatttgagaggcggaaggcacaaggcgtgacaattgatgggatttgggatgtaaagagcaagagaggactcaagcacagtcgcctcgaggtttctagccccggctgctgtcaccaaccactctcaggaaggtaggcagaaggttacgcaggagaaaccgtaggggtagttctgaggccctggaaggggtagttctgaggccccgggggtgcggagctgcaggtccagggaggagtggtgaggctggaggaaggtgaggctggaggaggaggttcaggaggctctgaggtaaagatggaggctggggccttgggagtcgaggagtttacccaagacgaagcatctgtgtggaagaaaagataaggctgggcgcagtggctcacgcctgtaaaccaagcgctttgggaggccgaggtgggcggatcatctgtggtcaggagttcgagaccagcctggtcaatatggtgaaaccccttctctactaaaaatacaaatattagccgggtacagtgcacctgtaatcccagctactcgggaggctgaggcacaaggatcacttgaacccgagaggcagaggttacagtgagccgagatcatgccactgcactccagcctgggtgacagagcaagactccatctccaaaagaaaaagaaactataaacatcattgaaagaaactaaagaagacctaaataaatggaaggaaatcatgttcatggattaaaagacttaatattattaaaatttcattacttcagaagtgatctacagattcaacacaatccctatcaaaatcccagctgtggctgggtgtggcggctcacttctgtaatcctggcacaaggtgggaggattgtttgagccgagaaatttgagaccagcctggcaacatgatctctacaaaaaatatagaaattagccaggcgttgtggtgccagcctgtagtcccagctacccaggaggctgaggaaggaggatcgcttgagtccaggagtttgaggctgcagtgggctatgatcacatcactgctctccggcctgggcaacagtgcaaggtcatgtctcaaaaaaaaaatcccagctggctttttttttttttttgagatggagtcttgctctgttgcccatgctggagtgcagtggcggacgatcagcctcagggcaggccatctagaagaattaccaaaaacaccaacccatttgtctctctataaagtgctgacatttgtgctctgcaacgtacagctgagagagcacaaaacttgtctgactcagcacagtctaggaagtcaagcagctcaatcttgaacaggacagtggtgtttggggggatcaagggaggggagcccagcgttccataggcgtagttcggtttgaacagaaacctggccagctctcctctctgcatgctcagaaggcccagctccatgccccacaatgtaatatctgtaagaagggacaaagaaggtgggtgaagcttgctcagtatcctgcttaatgctatcagtttcttccccctctaagtcagcagtactctggcctccatgtctccctcacacagttccctcttcctgcaatgtcttcctcctgagcctgtgcccagcttctagtgatagaaattttattcaaacttccgggctcagttcaaatgccccctcttccaggaagccttccctgaacttcccagctagaattaatcatgccttcattaagcacacccacaacactgctttcacctcccaggcactcatccgattctaccaagtgagctgagtgcaggtcagtctcctctactacattgtgaggtccttaagggtggagatgttctaatcttctgagtacaacctctcttttcaccatgtattgtgggaagtaagcattcgtcgatttttacttaataaatgaacaaagaaacattcccagtggtgagttaagtcagagtgcaaagattataccttgcccattaagccatctcccaaatgcctaggtctcaaggggagagaacatggctgttttaccaaaacccagcctcagcaaagtcaactcaaagaacctgcgctctgagcagtcttcccagcctgaggcatggtgcctcatctcgctcctaaacaatcccttcttctccagctcctactctgaatttaccctctccaagtttcattagccgaggagttttcctaaagtaattagaatcgaagggtctgtccaagtgttccaggtatccatagtatttcactagaatagaggaaagaatgtaaggaaaatggacccaaaacacccacgccaccataatatcgagtctctcatgatcacacagaaacaatgcgatcagatgagcttaagctgcccgacaccacgaggtacaggaataaatctctctgcattttaggagcctacccttcggctcagaggttcaagagcttcatggaagcatcacgcaaaggggacatagggttccttagctttcctcttaaaaaaactaattcatggcagaagcagcggctcacgcttgtaatcccagctactggggaggctgaggtgggaggatcacttgggaccaggagtctgagaccagcctgggcaacatagaaagtgccccatctctacaaaaatattaaaaattagccgggcatggtggattgcgcctgtaaatctcttatttgggaggctgaggctggagaatcacttgagcccaggaagcagaggctgcagtgagctatgttcgcaccactgcactccagcctggggaactgagcgagaccccgtttcaaaaacaaaaatccacttcaaacaaagcatttccaaccccattaaatgctttttgaaaatgaggcctctctcttcccaacagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtcccttccaggactccctggtttaacgcgcttccccccatgtcctagctgccctccctgtggcgtgacgtcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacggtgagttgccaggtgtggcccgtaatcggagcgcacaaaacatgatgggacacgtaacgggaccacacagggcacattgggcacttgcaggggcgcgaggtggcggcacgtaatgggagcgcgctgagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctgggtacgtaatgagagcgagcgggaaatgatggggcacctaacgagcacgcagagcatgatggggcacgggtgcgaggtggggcgcacagtgggagcgcgtggggcgtgatgggacacatggcgaggccgtcagggcacaggggaagcacttttggaacacgtgagtgacagggctgccgcccttgaaggagccctcggagtggctgcgtggtggggcacgtggggcaggttcaggaaaaaggatgcagcatgtgattgcagggcaacctggtgaggacacgagagccacctgccaccagcagggttcagggctcccagctgtgggttacttccaccttctttcactttccctcttccattgtattctagagaatttaggcccagacaagacactgattgattgattgattgattgattgacagaggctcgctctgagcccaggctggagttcagtgatggatctcagctcactgcagccgccacctcctgggctcaagagatcctcctgcctcggcctcccaagtagctgggattacagacgtgcaccaccaggcccagctaatttattttttagtttttaatttgctggtaagatggtttgtagctttgttgcctaggctggtcttgaactcctggcttcaagcgatcctccagtcttgacctcccaaagtgctgggattataggcgtaggctacagccaactttcaatactgccccattgggggttacgtttccaacacatgaaattaggaggatacattcaaaccacagcagtatattatgaccataatattcattaactgtgtaacaggctgggcgcggtggctcacacctgtaatcccagcactttgggagaccagagtgggtagatcactcgaggtcaggagtttgagaccagcctggcccacatgatgaaaccgcctctctactaaaaatacaaaaaattagccggtgtggtggcaggcgcctgtaacctcagctacttgggaggctgaggcaggagaatcacttgaatccgggaggtggaggtggcagtgagcctgattgcaccactgcactccagcctgggcaacaagagcaaaactctgtctcaataaacaaacaaacaaacaaaacctgtataacagagtgtcattgaatttctaaacgttgaaagacttcacattaaaaaaaaactcacaatttaatattattgagtgaaagaaaccagacacaaaagggtacattctatatgatgctgtttatgtgacattcaaaaacaggccacatgacaacatggtaataaggacagtggctgtccttgttaggagttatgactggaaggaggcaggagggagctttctggaaacactgtacatcttgctcttgagagtgcacgtatatacatcaagtgtttatcaagctgtgtggttaagatttgcacacttgtatatgttatacctcgatttaaaaaatctaaataagtaaataaagataccttcaaatcttttaaaaaaaaaaaaaaaagaggccaggttcggcggctcacacctgtaatcccagcactttgggaggctgaggtaggaggattgcttgaggccaggagttcaaaaccagcccaggcaacaaagtgagacccctgtctctactaaagtaaataaaacaataaaataaaaaaaaaaattcgagagatcgaaccatcatctgccagtttgtattagaaaaaaagagagagagaaggaagactgcgtgcaataaggctcatgcctgtaatcccagcactttgggaggccaaggtgggaggattgcttgagcccagaagttgaagaccagcctgggcaacaaagcaagacccggtatctacaaaaaaaattttaaaaattagcttggcatggtggcatgtgcctgtagtcccagctactcaggcagctaaggtaggaggatggcttgagcctaggagttggaggctgcagtgagctgtgaccacgccactgcactccagcctgggcaacagagcaagacactgtcttcccctgccccccagccccccacccccccaaaaaaaggatataagagcaagagattgagattcagaaagaactgtttcccagcacctgtctgctcctgtcggggtcgtgaggtgtggacagtgtgcctagtccctctgtttctgcccctcctccacagtggccaaggccagcacttgaatgttatcagagcaggcccaacaaaggctgcctccccagtcctgtgatgtaacccagtttccacctgattctggtgaccttggggacacaggggtgttgctggggaaggggaggagagaaggggcagagaccaggcagtggtgcaggcgtccagctgcacttcccacttctgactctgtgcctgctgttccctgctgggaagaagaaaagccagtgatgctggcttgaggccatagtgggaggcccagtggatcctgagaagctaggtattccaatgtcgggctctcgctgggggcttctggtgcttcttctgtctcactgacaagctttcataggggagcaggtgggagatcagggtagaggccttgtaggttccaggctctctagaattacctgggagtgtcacctataagtgtagagttctgggtctcactggagaccccctgaagcagatcctttgaaggtgggcctctagaatctctattacacctatgctttcaacagtttcctgaaagtttgggaactgatctagaaggtggggagcttgcctaggttttgctgttcagttctaggtccggatgcatgctggggctggaccttgcattattagtgtcactgcaaatgaccctgcagatggcccctttcatgcttgtctccaaatttgagtaaaaaatgtagacacacacacacacacacacacacacacacacacgtatcttcaagggaccagttttttcactgcagtcttttgttttacagctgtggaaactgaggcccaaggtcatgtgggttaggactgggatccaggactcaaagtgtttcttataaaattctggtgctccttagggttgagggtggtgggtgagtgctggacagggggaggggagtggacaggactgaggtcggatgcctgtgtttcagcccgggcagtgagtgtggatggcttggcaggtgagcctgctggagctggaggaccggcttcagtgtcccatcagcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggtggggagtgagggtgcaggcggggcggcggggcccgcggggactggatcctgtgctctctggcgctatcaactggcaccaaaacggatccagctatcctcgatttccctgcagccctgccctggcgcattcattccttagtgtttgagcggcagctaaacccaggtgctggggattgaagctacacgcacaggatgggagctccctggtgtcacgtgctcaccccttcctgttttttgtttgcagttctggtttgtttctttttctttttttctttctctctctcccgcccccttcccttcctctctctctctctccccctccctcgcccgccccccctttctttttcttctttctttttggagacagcgtctcactctgttgcccaggctggagtgcagtggtgtgatcatggctcactgcagcctccaactcctaggctcaagcaatccacccacctcagcctcccgagcagctgggactacaggtgcacaccaccatgcccagctcattttttatattttgtagaaatggggtctggttatgttgcccaggctggtgttgaattccttggcctccaacgatcttcctgcctgggcctcccaaagtgctggaattataggcatgcaccactgccctacgccccttgtttgtgtctggacactcccctgtttgcactctctggtgcatgagagtggggacttcattttgtcccctggtgtatttcagtgcctggagccatgcctggcacattgtaaatgtccaaaatgctgaatcagtgaattcctgcctttataggccatcaccaaacctagcagatcattctttaagatgagtaataataatacctgactgggtgttatatatataaaacacctgttataaaacacgtgactgggtggcttatgcctataataacagcactttgggaggccgaggtgggtggatcacttgagtccaggagtttgagaccagcctgggcaacatagtgagaccctgcctctacaaaagtttcaaaattagcctggttggccaggcgcagtggccactcctgtaatcccagcataaagctggagggagcatgggtgggggcgagatagggccagcgaggtaagctgcggctggggcatggagaggccagtgtgacccgggaatggatttggagtttattcacaggatgagggagaaaggcgggggctggagtgttttaagccagtgatgacatgctcagatctctctggcagaggggagctttgagggtgaggcaaaaggacagtgagagatgaaggtgccaggacctaagttggtgggaactgggacaaaggcctggggcagaccaaagacaaatttcaaacagaaaaaaaccctgacaactgtgtgtggcaaggagggtgagggatggggaggttgactccagctctgtaattcccccttgcacagaggaagtgatcgcaggggaggatccggcgtgggcaggtggagcgggaggtgcctggggatgtgcagtcgggttgaggggtgtgcagaccaggacagcggtggggctcagggcaagaggtgtggagggtccttcctcttggtggtcactgaagtcccctttggtggagaagaccaacccaggagagtctacatagtgataagggaagacactgatgatgaccccaaggggtaccaggcttaaaatctggattgagagagagagagccctgaaaaaggaatagaaagaatcctcagagcaggaacaccggctgagtgtggcctcccggaaatcagagagacagactgaaggaggagatcacgtgtgtgaaatgtctctgaggactgaaaagtgttaaatgtagcagtaagaactgattatcttggcaagagcaggtttaggggagtatggaaggtggaagccaactgcaggtgaggaagccgagtttatgttttattagttgatgggaaggagggagggaacaggctgggagattgtctgtcctttgtagttacgatccagcagctcagcttgggtccctgttttagatttgggcttaatttttttttttttggtagagacagggtctcactattttgtccaggctggactcaaactcctggcctcaagtgatcctcccgtctcggcctcccaaagtgctgggattccaggcatgagccactgttcccggccagatttgggttttgatgatcctgaggctcttctctgttgcaacacagaatacaactaaattgcactcctttattgccctctttaaggtgttcccgttgcctcctgtttattgagatcttgagatgctcgattgatgggtgcattgatttgcataacttagttcttctcacggggaaggaatgagtcccgtctgtctgcctggggagggtgacattggaatgctgttcttaggcctctgtgagatgttctgatgcctcattctccagagcaaggactctgtccgtttatgccagcaagtgcttgattctttacccaactcccttcctgaaagccccttgcagctctctggtgcttgggcacgatccaagccaaaaattctgtacattgcatgggtataaaccgacgggggctctggtcaagtcatggagtagatggtggtccaggagtcctggttggcacccccaaggctaggtcagatttggggcccgggcagtccaggagaagtgcatttatgtcagcttggggaggtcgcaaatccgtgctgtgtccaagcccaccaggaatggattcaggtgtttataggtgtggggattcaccaggttaaacccaggcccgtgtgagcaccactggccctagaattagcctcacctggcgccggcctttttgtgatggctcctgattaaatacccactaattctggatctgctggtgaccacagagttcacctgatgggtcccctacaggcagcattcaatccaggaagtgccagcatcacatggtgacttctggtagctgtaacatttagtgactgtctccatgtcatgcacaggggtgacattgagaccctcttatgcctgggaagttcctgctgtcaatgcagaatattctctttttttttttttttttgagacggagtctcgctctgtcgcccaggctggagtgcagtgggcgatctcggctcactgcaagctccgcctcccaggttcacgccattctcctgcctcagcctcccgagtagctgggactacaggcgcccgctaccacgcccggctaattttttgtatttttagtagagacagggtttcactgtgttagccaggatggtttcgatctcctgacctcgtgatccgcccgcctcagcctcccagagtgttgggattacaggcgtgagccaccgcgcccggcccagaatattctttgaagaaaaaaaaaacattagagatgggatttcactgtgttgcccagtctggtctcaaattcctagcctcaagtgatcctcccatcttggcctcctaaagtgctgggattacaggcatgagccactgtgcccagcctagaatattcttttttttttttcttgagatggagtcttgctctgttgcccaggctggagtgctgtggcgcaatctcggctcactgcaacctcctcctcccaagttcatgccattctcctgactcagcctccggagtagctgggactacaggtgcccgccaccatgcccggctaattttttttgtatttttagtagagacagggtttcactgtgttagccaggatggtctcgatctcctgacctcgtgatcagccagcctcggcctcccaaagtgctgggattacaggcgtgagccaccgcgcccggcccttagaatattcttgaattatcttattttttatttttattttttgagacagagtctcactgtgacacccaggctggagtgcaatggcatgatctcagctcactgcaacatcaatctcccaggttcaagcgattctcgtgcctcagcctcccaagtagctgggactacaggtgtgtgccaccacacctggctaatttttgtattttcaatagaaatggggtttcaccatgttggccaggctagtctcaaactcctgacctcaagtgaagtcccacctcagtctcccaaagtgctggaattacaggcgtgagctactgcgcccagactattcttgaacaatttaacctgttttggactcaagggtacctgggtggctctggttcccgccctggtttccctgggagtgcttgtggccattgggatactcccaagaaggtgatccaaggagctgagaaggggagggatcagctgctcatggggccatggcctgttgcctccaggaggagctcgcagccctcttctctgagctgaagcaggagcagaagaaggtggatgagctcatcgccaaactggtgaaaaaccggacccgaatcgtcgtgagtgccccttccctctgcccctgcctgggaccggccaccttcactttcctgtagagctcagttctcattggtcctttacagaaaaccatgccttccatataaagccagaactcaaagcattccggggcggggtggggaaagcgcaaatcctctcaggggaattcaacccagttgtcgttaggactggctccaagttggcttttgccctctgtgtccttgagactgagataacccaggacttgagtctcgggggtaaacagctgaaagcatgggcgtgactcctccgcccctgtgccacctgtgtctgcttgaccttgccagcctgtcatggtgccctcccagtacctgggtgcgcaggcgtggagaggctggcagccctgggccctggctgatctcctgaactgagaggcacatggggctgggacgcatagtgccccggccctggaggtggctgtgaaacagaaacaggagccgagcaagatccagaagcacttggcctccctcatttaccctcctcacccttgcgcggcaggcggtatcagccctgcctggtggaggcggagctcagggttctgcagggagttctggctccctcacagcaaagcccgctcgcccagggccttcctgctttccttcagttgtggaactctgggatatgcacatttaatagctgaaataggcaaagtggggtgtggtggcgtgcatctgtaatcccagcaactcgggaggctgaggcgggaggattgcttgaggctgggaggtcaaggctacagtgagctatgatcgtgccactgcgctccagcctgggcaacagagtgagaccctgtctgttaaaaaaaaaattaaaaattaaaacaggccaaagcagagcctctccatttgaaatgggagctggggccaccctccccacggccaccgccagggctccccatgcatggggtgaactccctgcccggcgccaggccatgcagcctcccctgagactcaggtcccaggaccaacccggtcaggaaggccctggggacaccgaggccagccagacagagcctggcagctcggctgtgactctgcagtgagcagccctccctgtcccagaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctgggtgagtggacagggaggcgtcccatccccatacccgccagggccttccccttcccaacagtgccctggcttcccaccttctagccttaacctccctctctcttgccttccagaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttgggcatggtggcatgcgcctatagtccctgctactcataaggctgaggtgggaggattgcttgagcccaaagtttgatgctgcagtgagtcatgatcatgctactgcatgatccagcctgggtgacagagcgagaccctgtctcagaaaacaaaacactagaggaggagcaggtgtctgggaggcctggcagaggggcacacgcctgatggctgagaagggcccaggacccgagtttgccaggcaagccgagggaacagtcctgtaaaagggggagtggcgtgcggactctggttatgagaagttcagggtggctggatgtaaggcaggatatcaggaggagtgggagctgggagaggtgggaaatggccagaagcaacatccaggagcaccaggcatcccttgcttaccgtcctcacccttgcgcagcaggcagtatcagccctgcctgaaacttgctctgcagattgtgggaagagagcggatccatgttctagacccaacaaacgaacacgtgcagttcccaagccttcctcactccctgtttatgggagactccttgtttctcacatttcttttagtcttagagacaatttggtcaggagacatgggtttaaatgaaggcacagagcctgggcacagcagcttacacctgtaatcccagcactttggaaggccaaggcagaaggatgacttgaggtcaggagatcaagaccagcctggccaacatggtgaaaccctgtctctatgaaaaatacaaaaattagctgggtgtggtggcacatacctgtaatcccagctactcgggaggctgaggcacgagaatctcttgaacctgggaggtggaggttgcagtgagctgagattgctccactgcactccagcctgggtgacagagcaagactccatctcaaaaaaaaaagaaaagaaaacaagaaaaaaaaaagtccgggcatggtggctcatgcctataatcccagcactttatgctcaagtctgctttttttttttttttttttgagatggagtctcgctctgtcacccaggctggagtgcagtggacgatctcagctcactgcaacctacacctctcaggttcaagtgatctcctgcctcagcctcccgagtagctgggattacaggtgtgcaccccatgctcagctaatttttttatttttaatatagatggggttttgccatgttgaccatgctggtctcgaactcctgacctcaaatgattcgcctgcctcggcctcccaaagtgctgggattacaggcgtgagccaccgtgcccagccttgagtctttatttttagagacaggatcttgctctgtcacccaggctggagcgcagtggtgcaactgtagctcactgcagccttgacctcccaggctcaagtgatcctcctgcctcagcctcctgagtagctgggacgacaagtgtctgctaccatacccagctaatatttaaatttttagtagagatgggatcttgctatgttacccaggctggtctgggcctcaagcaatcctcccaccttggcctcccaaagtgttgggattataggtgtgagccactgtgcttagcctcccataaccctttgattcacgatactcataggctaagtgggtcctggaagctccggggtagccttctaaccaagatgctggctctggccactggaagtcaaactgggtgcacagaccagtgagagggcatgagggagcctagcaggggtgaacagcaaccctcagcctccccacagccctgcctctcctcctgcctctcctcggtctcctttgaggattcagcctctcgtcctcaccacttatggtctgagggcctccaggctcctcttctggctgtctacccctccacacccatagctccagtcatcacttccacagggatgactcagaagttccctctccgggagacccgtcccttacaggccacatccagtagcgctccagccattcagcagctccgcctggacgtcaagggcatgtccaaaaccgcgctcatgatcttcctactcccccatccctgagatttatcctgtggctgtggtgtcctgtggctactgtaacaaatgaccacaaacttggtggcttcaaacaaatttaatctctcatggttctgaaggccagatgtccaagatcacgatgacggcaaggccgcgctccctctggagactgtcggggaaaacctgcccctttcctcttcagcttcaggtggtggctgccatgccctggtgtttcctggcctgtgaccgcatcattccaatctctgcctccatcttcacgtggccttttctgtatgtgccggtctaatcttcctctgcttctctcttattttttgttttttgagacagagtctcactctgttgcccaggctggagtgcagtggtgtgatctcggctcactgcaaccgccacttcccaggttcaagcaattcccttaacttagccccctgagtagctgggattacaggcgtgcactcagcaaatttttgtatttttagtagagacgtggtttcaccatgttggctaggctggttgtgaactcctgggctcaagggatccaccagcctcagtctcccaaagtgctgggattacaggtgtgacccactgcgcttctccctataagagaggccttcctctgcctctctcttatagggatacttgtgatgccatgcaggacctgcccagataatccaggataaccttctctccaaatccttcccctgatcactcctacagatctcttccatagaaggtgacatttccaggctctaggaattaggacctgctctctctgggtggccgttgttcactccaccaccccaggtttccccatcctaccaaaagacacagcagcattgtgtcaactgcccaaactgaaaacctatgagttattctcgacctgacctttttcctgagcaagttctgtggatttaacttagcggtcacactgccaacttcaaccgaactccactgccaccaactcagtccaggccaccagttcttgtttaggtgactgccatgacccccattggtctctccctgcctcaactctgtcccctccatcctatatccccacactgtaaccagactgattatttatttatttatttattttttggggaaagaagcttgctctatcccccaggctggagtgcggtggcacaatctcagcttactgcaacctccgcctcccaggttcaaacgattctgcctcagcctcccaagtagctgagattacaggtgtctgccacaatgcctggctaatctttgtatttttagtagagacgggttttgtcatgttggccaggctggtctcaaactcctgacctcaagtgatccacctgccttggcctcccaaagtgctaggattacaggtgtgagccaccgcacctggccagactgatctttaaagaagtatacatgaacacagcactccatgacttaaaacccttaagaggactaccatttatctcaagataaaagaacaaaatcctcgctgggcacagtggttcatgcctgtaatcactgctttgggaagccgaggtgggaagatcactttaggccaggagttcgagaccatccatgggcaacatggtgagaccgcatttctacaaaagataaaattagctgggtgtggtggtgcacgtctgtagtcccagctacttggagggtgaagtgggaggatcacttgagccctggagttcgaggctgcagtgagctatgacggtgccactgcactccagcctgggtgacggagtgggacctcatcaaaagcaaaaacaaaaccgttattgtggctttgaggcctggatcataactacatcatttaatttggccaaaccggcccatttcaggtacccaaataccccacgtgctttcttgcttggctctgggactaatgtggttactggtgcagggtgagtggcaggtatcatgaaccacattgtggacctggagttgctaggaccttttctgccattacacagaaaaatcctccctgagaacacagccattggaggacacatggcagaggaagataagacaataaacagagacacataattatggccagcgtgggggctcacgcctgtaatcccaaaactttgggaggccgaggtgggcagatcacctaaggtcaggagttcgaggccagcctggccaacatggtgaaaccccgtctctactaaaaatacaaaaattagccgggcgtggtggcacgggcctgtagtcctagctactccagagggtgaggcaggagaattgcttgaacctgggaggcggaggttgcagtgagccaagatcgcgacactgcgcgacagagtgagtctttttgtctgaaaaaaaaaatatatatatatatatatacacacacatacacacatatatatatacacacacatatatatatgaaatgaccaatacacatgtgaacatattcaacgcaataactgcggttaaacagcagtaaaatcccattatttatccatcagattgacaaagactgaagaactggagaagaagtggcgaaacgggctcgcagcgtcgcattccctaccccagcaggtgcgcccgcagcgtcgcactccctagcccggcaggtgcgcgatcacacacacaccctgcagggggacttcgaccggcacttccggtcccggaagggcatgcccttggaccccggaagtccgggcgggggcagagccgggtgcgctttgcgacagagccgtaaaggcgcgcgggaacatggggctgtacgctgcggtggcaggcgtgctggccggcgtggagagccgccagggctctatcaaggggctggtgtactccagcaacttccaggtagcgggcccgggcgccacaagtaggggtggggggtgaggaacccggggtggggtgggacgggcccggatggggtcgggaggtggggcccggcgaggagggccgggggagcccccgacccagcttgtctccctcggccacacagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgtgatgtggccactgcacttcagcctgggcgacagatctagaccccattctaaaaaaaaacaaaaaccccaaacccacacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctagcctcccagctgcctcgatttgtgcgtgtgaacactctcaagacctgctccgtttatgtagttatttcaagagacaaggtttctcctatcagggtcgggcttccaggtgagagcttagagccctggctgtcctcatctagggaggtgtctggggtactgggaagagaagtggttggatagttgtgactttgctctctgggctttgttcctacctttccagcagtttctccatctccaaggtttgttttcctcgcatcccttaaacatcgaactcctaggagccccatcctacattcttccggagctctccgttttttctctaactttagctcctgcctcccacctggtgattctcaccgcccagtgtagacttcccttttgcattcttccctccttaggttcacatgaatgcaccacagatgccacagtcgctgcattcatctttcctctcagactttacacttagtacatccccagtttaatctaacagatgtcaccgttttccacccatttggtcaagccagaaaccgagtcatcctaggtgcttccttcccctccctccaatcatttactcctccaccttgagcatctttctcagctccactcctttttttttttttttttttaggactgagtcttgctctgtcactctcaccgaggctggagtgcagtggcatgatcttggttcactacctccaaggttcatgcaatgctccttcctcagcctcctgcgtagctgggattagaggctcccaccaccatgtccagctaattattgtatttttagtagagatgaggtttcaccatgttgaccaggctggtctcaaactcctgacgtcaggtgatctgcccatcttggcctcccacagtgctgggattacaggcgtgagccacagtgcccggcctccactcctttctcttaattcccccggacactgcctaggttaagcactcatttcttattgggatgaccacaagaacttcccagactggtctctctgcttccagactgtctcactgcattttccttgaggttgactgtaggaagctctaaaggcagatctgatgcattactcctctgctaagcctttttttttttttttttttttgagagagttttgctcttgtttcccaggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcaggtgggacaagagactgagaaaagaaataagacacagagacaaagtatagagaaacaacagtgggcccaggagactggcacttagcataccaaggacctgcaccagcactggtctccgagttccctcagtttttattgattattattttcattatctcagcacaaggaatgcggtaggagagcagggtgataataaggagaaggtcagcaaaaaaacatgtgagcaaaggaatctatgtcataattaagttcaaagggaggtactatgcctggatgtgcacgtaggccagatttatgtttccctccgcccaaacatctgtggagtaaagcataacaaggcagcattgctgccaacatgtctcgcctcccgccatagggtggtttttctcctatctcagaattgaacaaatgtacaatcgggttttataccgagacattcagttcccaggggcaggcaggagacagtgcccttcctctatctcaactgcaaggctttcctcttttactaatccacctcagcacagaccctttacgggtgtcgggctggggcacagcctctcatcccatgaggctatatttcagactatcacatggggagaaccttggacaatacctggctttccagggcagaggtccctgcagcttttcacagtacattgtgcctctggtttattgagactagagaatggcgaagacttttaccaagcatactgcttgtaaacgttttattaacaaggcatgtcctgcacagccctagatcctttaaaccttgattccatacaacacatgtttttgtgagctcaaatttggggcaaagtcacaaattaacagcatctcagccaaccaattgttcaaggtacaggtcaaaatggaatttcttatgtcttccctttctacacagacacagtaacagtctgatctctctttcttttccctacaggattgcaggcatgcagcaccatgcctggctaattttgtatttttagtagagacgggatttctccatgttggccaggctggtctcaaactcctgacctcaggtgatctgcccaccttggcctcccaaaatgctgggattacaggcatgaaccaccgcgcccggccatgctaagtcctttcttggctccattgtgctgtccctcctgcttcctctccaggtccatctgccacagtgctacgtgcaccagcgtgccagcaacagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacccggcccctgtgttctgcctgccaggccagctgtctcccagccatgctgctggacccctgccaggctcccatgtcatcgatgcctgtgccgccccaggcaataagaccagtcacttggctgctcttctgaagaaccaagggtgagtgccacaggaggaggaggaggaggacatggggtttgattttgtgcctttcagtgggtaataaaggctgaaaggatgactttcgcttaactctttcctgctgtaccaaagtagttcacggtatttgccccaagctaagctttccccactgcaggtgtgagatgtggatcccttagcccttggggcagagaccccaggccagttacctctgaccctgggccctttaaatataggccgtttcaatattgtgtgtcctggcttaacctgcatgttctggttgtctgtgtcagctgtgacaggcccttagctgctccatgcatgctcagctcacccctgctctgccctctgccctaggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctctctttcccttccctgcagcggctcgtctactccatgtgctccctctgccaggaggagaatgaagacatggtaccagatgcgctgcagcagaacccgggcgccttcaggtacagggcgggcgccagggtcgtggaggggggggatggggtgaactgctctcttacccagcattggggctgtttctcttgcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactctacgatagatcacagttttttattcttaatgtcacaagcaggagaaaaatctcacattcatactaaaaattccaactagactcaacaggaatgaagtctctatttgtaatggaaagtcccagcctcccgctgccgtccagtgtgtgtactgtacacatccacactcactctcactcagggttcccggaccggctgtcctgcctgcggaactgaggtaaacaagctcaggtactgacactaggagggtctaccttacataaggtacaggtagaagcttgattgctaggcccaggcccacccagaccctccaatcctaacaggtatttaggcttgaggttcactccctcctcagctgcacacgcagccaggtataacactcgccctcagtcacaacggggagggggcaccggttacatctacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgtttaaatatttttttcttttaatttagacacacgcattcatacttctcccaaagaggttgggcgtgacagcaaggcgcttgggcctggggtatgtggtttcagaaggacggaaggaaaggatgggctgcagagggccctgtttgggaaaaataggattttaaaaatatggttcattaatttaggttttctaacatctactttgggtgacgtagcctccagtgaggtcagttaagtgggacagaaaccgcagagggaagaggtctttgcttcccctgggcccattctccctggctgccagcccttgaagtcagaacaccatgggaaaattcaggagtcggcacttgtagccgtcaagtggtgctactttccacattcaattagcgaggccccagaaaacttgaaacaggaagtccggcactaccaacatgccgccactcatacaactcaactcttcctccaaactcgattcaaagagcaatacacagagcgtcagacaaaggaacacaggacaaggcttgaaacatacaatcctggagaggcagacgagggcccaatggggccaaagggtagctgggcgaggaggcagctgaagcagcggtgggcatcctgcctgctccaagagcttctcccttcatccctggctctgccaggctaacagtcttgagccaccaagctctgaggggccaaactggcagagggttggagatgaaacattgattcaggcttggcaggaagaaaacggcaggagcagcacccactggggtctccaaggcaaagctagattcaagggcatttaaaaaggagggaatcctgcaaggaaccggtgagggacacagcagcaagaaatggggaaacagagtccccagaagggaccagaggaagagaaccacttctcacagctaagccaagcaagataaagctttacggatagcccatttcccaaatcccatcaggtgcacaccaccgatccaggcgggctggaccctgccccctccagcgacgacggctctcggggaaaggtggaaggggcgcctgcctaagggtgcgctaagcgggagtcagggcagcggacactatgtacaggtgtttccttagttctccagcctccccagtggaactgttcaagtagaggtcccgggctttggcctccgcatcctgcttccccttccctgaggcttgtgcttcctccagaagggaaagggccccagggctgccactgccccctggcggctgaagccagagatccggggtaggtttgctttacgcagctggaagggtccaaggctctttctagcacgtgccaaggtccagatttagggaaggggtggggggaacagggacaggggacaaaggctactttttgcgggtgtgctgccttcgggcctgcagtcgctgtcgagcccctggggtcttggatcccgcaccaatggaaaatgaaggggccgctgatcctggaaagattcaacaagacctcatcagggcagctgctacctgagactctggctctgggtgcccaaatctctggaaggccaggccagtaataaaacacagggtgcctcaatagggctttccccgctgcgtcagaaacactggacgggaggagcctcctgaaatgcaaactcccagagtctcagagcgaggcccacgaatccatttttacctggcttcccatgggaggcaaacttccaccccggacagctcctctctgatctctgccatccaactcccatccctgggctgtgctgtactcctaacccgaaatgtctttcctgtgctgaacctgatcttcacggggcctcagagggccaggagcctgccaccccacccaacctctcctcagacagacgagcagggccacagggtggcttgctgcttaccgaacggtccaacaccaacaaagccttgggcgggtgctgaagatgccccaaaggagaggctgctgcccgatgtgcccactccaggcgcaggggtgttctgaccaaaggtgggggtggcggtgcctggaatgaagagaacagagagctggccagtgagcagagggcggaggcaggcgaggagccgggcaggagcctgtgctctgcagggcacttcccacgggaccctcagccccagttctgcttctggggcactcctccatcagcagctgagccagacaaccgagtcttcatgcctggtgccccagctcagcctgcttctcccacccgctaatggccacgccagggcagagaaaaagcccccctgccccgcagccacctcgtgggcctcctgaccatcgctgcagaggggagtactctggggcccccgcctcctagcgtacctgggttggctacctcctctgttcaggccttttccccctagccaccgtcccctcccctctgaagcctggtttgtccgtcctgtgtcttttgtgatgccccgtggtcccctcccttccccggccttgccctgactggctctggctgcctgcccgatgccctctctggcagcccctctgcagggatggctgctctcagggcttggcctccggcccggacaaggggaagctccctgtgctcccacgctgcttccacacagtttctcttccttccctaaataccgtaactcaggttcaaatcactttaatctgccatgtcctcatgtcacctgtcaactgccaggtcactccctgattcacagaggacccttggctcactggcttcctccccatcaccactcacggtgacttcgccctgtggggctgactgatggtcctctcagcccctcggccctgccacccccatgacctcctctccccgacccctgccaccactcctgcagccacactgtcaccacaactgctccggctcccgaatctcctgcaggcaccacccctcctgcagctgacttcacccgctctccactcctgcaccccctgagctgcatcggggcactgacccgctgcccctcctgctgtgcttgctggggtctccacagccgggtggcaccagctgtccgctgaccttagatctatacccagtgtcgctgggaaacacacgccatgctaactggcctcactttaacttcacaatcacagttttccagcccacaaactgcctggaaactgatcacactttttaatatgatgttcctttcccccactgtccaaaatgactatttcaaaagaccccttttttatacactttatcccgaccttccctctcccagattttctctcctacttcacgaagcaaacagaagccatgggatctacattcatcttccacacgggaggaaccatcactgcatccttctgcctgattctgcaatggttttcctgaacacttaagacccaaacacccaaccctggccacaaacaatcctcgcctcttggcctccttccacaccactgctttagctcctgccctcctgccatgcttgtctttgttctgctcttcaacataccaaacatgtttctgcctctgggcctttgcatgcgccatcctgggcctgaaaggcatgtccacttgtgctgtgcccacccccaccccacccccatattcagcttacgcttgagacagtcttgctctgtcacctaggccagagtacagtgtggcatgatcttcgctcactgccacctccacctcctgggttgaaacattcttctgcctcagcctcccgagcagctgggattacaggtgggtaccaccatgcccggctaattttttggtatttttagtagagacagggtttcgccaagttgcccaggctggtcttgaactcctgtcctcaagtgatccaccctccttggcctcccaaaatattgggattacaagcatgagccactgcgcccaaccttcagcttacaattgttaagtactcagaaggcctttgaccagttaaatccacaatggctcctccagtcattactacgttagcaaaacatgtatcatgccctggcatctcactgagttctatattcagtgcctgtctcttcactgccacagcataagctccccgagaccacaggcttcacaggcacagcttttcagtgtccggcccggtagcccaagtccacgcccctccttacctccaaacacaggtttgctctcagttgtgctgcccacgttgaaggcaaacggtgtgctctggccggtggtgcccagggcgttctgacctaagccccctgcgaagggggtggaggtggctgtgctcccactctgtcctgctccaaagctgaaagctccggtggtggcgctggagcctggggtggccacgttgatcccaaagctcccactgccagcgggggctgccgaacccccaaacgtgaagggtgatggtgttgtgctgccaaacaccgagctgctgctcccgctgctggcggtctgggtggtggctccaaagccggagctggtggctgcaccgaaggagaagacagcagtggagccgccaaaggcgggctgtgagctggcgggagcgccgaaggccgaagccgtggctttcaacccaaacgccgagtgcgtggcaccgccaaaggtaggctggatgggcgtaggcacgtgcgcaggcacgatcttgatcgtggacgcaggtgcaggtgtgggtgcagtagccggggccggggctgcagagtttccaaaagtgaaagagctgccaaagctgggggtaagggctggcttggcggcccccggtggctgcccctcagcggccccaaatgcgggctgggggttggctcccggatatgatgggagcggggacttggcgcttgagcaaagggaatgttgaacgtgggggtgctcgtgttactgaacgtcagagtgggctggctgctggtggccggggcggaggtggcgagggtgctgccaaaaccactaaagtcggcagcgctgctgctggtggccgttggcacggcagtgggcagggactggctgaaggtggtgactgtggtggttgtgggcaaggcaggaggtttgccaaactggaatatggagcccatggccggggtgaagctggcagcagaggcctggggcgccccgaagaggaaaggctgtgaggcggcagtggcggtgctggtcgtggtactcacactgctgctgctcacactgtttatgccaaagccaaacgcaggcttcgaagcagagtctgtggatggactggcagaggtgatgggagccacagcagaggtggcgctggccaggccagtgaagagcggggcagttgtggtgggagcagtggcgggagtagttgtctgcttgaagaagggagcaggcaagggcacagatgcaggtggccccatgctgctaaagacaggctggaaggtcggggctgtggtgctggtggtcgtggggagggaggagctggagggtgctgtggctgagactgaagggccaggcggtgtgaggccttccttctcactcttgggtggagccgtgaaaatgggcttgaacatgggagatgctgaagatgcagcaggggcggcagggctggaaggtgaggtgttctgtgttccaaacaggaagctttgcttgggggcgggggacggggcagatgtggcttggggtttggtagccgtctctgcttgaagggttggaggtgccttggtgtcagtggctggtaccatggatggagcagggatcagccccagcaaagtggtcgggggtttggagtcaaaggaggggctggggagcagccctggcggccctgactgtgataaacccagcgggggtaggaggctgggtgtctttggaggtgagagggcctcagtggttgctgctccagcagattctggaagaagaatagaaaatgtgaaattggaataaacacttcaaagatgatggtattcagtatttcagcgtcctccccatgcctaccacagagcctgggatccaagagtcagtcaataaactcagctaagtctacactacaggcctgtacagtaaatcaaggaagtgttcattatttccacctcacagatcatcagacagaaggggataaaatggggcctaaatgggggcctaatgtgtagagactaagacagtccaattgtctgaactctgaagttcacgtatgaatctagatatactttatttgcctactaagctcacctgccaggcgctaagagcacacaactatgaatggggaagtctctgcccttgagcagggagggtgcgtacgaaccccaggttaccgtctgataaagaggtgtgcgcgcgcagtgccgtgaaggcctgggccgggaacaccagcagccctcaaagtgctggagggaaaggaagcagtgttgttctggaccagtagttctgacaggcaaggatatcctgaccacgccaccacattcacacttcagaggtgctgcaccgggaagatcattctcatctgacagatgaggaaggcgaggctcagggcagctaagccaggcttcagatcctgagcgtcgcagcaccccttctctaacacttcctgatgtgggctccggcgctgttaaacgtaggcccgctccggtgtgctgagccagggtgcgttcggcctgcagagcaatctccagcgactgacaggcacgacgcccttattccaacccaagccggggatgctgctcagaaggctggatccacggccccactccagctcacctgggcagggtggcaggctcgggggagtctgcatcttcttcaagctctctaacagtgggttggtgcttggggccaggagggaggtgggtggggaggcagttgcagcagcaggcagggtaaaggtaaatgaaggctgagtggtagttggggtctcagtgacagagttcgaggcagcatctaagaaagaaagaaaggtgaagcagtcctggcttgtctgggacttctttccacatgcctgtcggagagcaggctctcagcacagctcatggaggaatgtctgccctaaattgcagtggtccctgctgtccagttcccgtgaagaccaacacggatatctcaggtgagaaagaccacaagaaaacatggaactctacttcggattttcccagagaaacccatttttccaaacaccaaaataaaaccaaagaaaacagacacctgaaacctctcgagagtgcaacgatctgtgctccttaccactcttgtcctccaaggcctggttgaaccactgtaatgaagccttcttctctaagtctaggtcctcggcagtgatcgaatagccaagctggggaggtggaggctaccaaagagaaaaagaagaagtcaggccaatcagaaaaaacgggaaggctgggcgtggtggctaacgccggtaatctcagcactctgggaggccaagccagctggatcacttgaggtcaggagtttgaggctggcctggccaacatggtgaaaccccatctctactaaaaatacaaaaaattagtcaggcgtggtagcaagcgcctgtaatcccagctacttgggaggctgaggcaggagaattgcttgaactcaggaggcagaggttacggttagccaaaatcgagccactgaactccagcctgggtgacagagggatgttgtctcaaaaaacaaaaacaaaaataagttagaaaaaaaaccagaagaaacttgtccttagcgttcctaagacttaggagagctaagccggggagggcaggagtagatggacaagaccataccaaggtcagctgttcccctcgccgagaaggcagcagctgaactttccgcttacgctgcccagagctgccaggtgtagactgagaattcgagttttgtttcttccttggggttgtatctgcagctaaagaaagaaatcaagactcgtttgcttccttccctcttccagaaatggatggttgtgtctacccacttcgcatttcacactgagttttcaatgatggtatctctgaaaagattcaatcttctatggtttggttgcttggatggtgtttgtaagattaaggcgcgcacacaaaccgcttactgtgcagtaattactgggatcacccacaggtgactcaaactgagcttacctctatccaatcgttagcccccatctgtagcctttctccctcatcagactataaacttctgaaggagaggaaatctctctctttgtatctaacatgccttagacatagcaatgctcaagaccttttttcaataggtattaatctctacatcctccacaaatacctccaccaccaacagcagcccctcctcctggctcagcaacctacccttttctccctgggactccttgtctgctgccaatggagttgaagaactggaatgatgacacagctcttcttctctgttgggaaaaaaggaacaatttagtctagaaagacttcttggctgaagtattaaataatttctcacaccctcctaactaccaagtggccaacatctaaaacaaccatcatttaagatctcagtatgccaggataaaaaaagtcaacaggaaattccaacagaatgaagggaggctgttcacagaggccatgaagacagtttttgtcttaaaacaagcacaaacaataatcttcaaaccttacttacaacctaccaagtccctgggagttctagacacagatgtgatccctgagggagtggcattccagccaactgcaagcacctaggggatcagctcgagtcaagaacctgaaggcgactgcccgctgacttgactctctctgctctccactctgcatggcctctgtgcttgcacccgatccctcatgctggagtgggaggcgacagccagaggccactggagtcagtatccaagactgtagggatgatagttgttcaggtgggtgctgcattgtccctctcagggacttagtttctttgattctccaagtcacagcagcacaaagcctaagagccaggttcgtttcccacctttcctcacccccttctgtccacgtagcaaatgaaaactgcaggagaatgccgaataccttattttctttgctggcctctccggtgtctgggagcgggatgaggctgggctagagaagggtgatgaactggggccatttctcttccagag

SEQ ID NO: 8795 - DNA, 16472 bp, Homo sapiens
cagagccgtaaaggcgcgcgggaacatggggctgtacgctgcggtggcaggcgtgctggccggcgtggagagcgccagggctctatcaaggggctggtgtactccagcaacttccaggtagcgggcccgcgcgccacaagtaggggtggggggtgaggaacccggggtggggtgggacgggcccggatggggtcgggaggtggggcccggcgaggagggccgggggagcccccgacccagcttgtctccctcggccacacagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgtgatgtggccactgcacttcagcctgggcgacagatctagaccccattctaaaaaaaaacaaaaaccccaaacccacacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctagcctcccagctgcctcgatttgtgcgtgtgaacactctcaagacctgctccgtttatgtagttatttcaagagacaaggtttctcctatcagggtcgggcttccaggtgagagcttagagccctggctgtcctcatctagggaggtgtctggggtactgggaagagaagtggttggatagttgtgactttgctctctgggctttgttcctacctttccagcagtttctccatctccaaggtttgttttcctcgcatcccttaaacatcgaactcctaggagccccatcctacattcttccggagctctccgttttttctctaactttagctcctgcctcccacctggtgattctcaccgcccagtgtagacttcccttttgcattcttccctccttaggttcacatgaatgcaccacagatgccacagtcgctgcattcatctttcctctcagactttacacttagtacatccccagtttaatctaacagatgtcaccgttttccacccatttggtcaagccagaaaccgagtcatcctaggtgcttccttcccctccctccaatcatttactcctccaccttgagcatctttctcagctccactccttttttttttttttttttaggactgagtctcgctctgtcactctcaccgaggctggagtgcagtggcatgatcttggttcactacctccaaggttcatgcaatgctccttcctcagcctcctgcgtagctgggattagaggctcccaccaccatgtccagctaattattgtatttttagtagagatgaggtttcaccatgttgaccaggctggtctcaaactcctgacgtcaggtgatctgcccatcttggcctcccacagtgctgggattacaggcgtgagccacagtgcccggcctccactcctttctcttaattcccccggacactgcctaggttaagcactcatttcttattgggatgaccacaagaacttcccagactggtctctctgcttccagactgtctcactgcattttccttgaggttgactgtaggaagctctaaaggcagatctgatgcattactcctctgctaagcctttttttttttttttttttttttgagagagttttgctcttgtttcccaggctggatggagtgccctggcgcgatcttggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacagtgggcccaggagactggcacttagcataccaaggacctgcaccagcactggtctccgagttccctcagtttttattgattattattttcattatctcagcacaaggaatgcggtaggagagcagggtgataataaggagaaggtcagcaaaaaaacatgtgagcaaaggaatctgtgtcataattaagttcaaagggaggtactatgcctggatgtgcacgtaggccagatttatgtttccctccgcccaaacatctgtggagtaaagcataacaaggcagcattgctgccaacatgtctcgcctcccgccatagggtggtttttctcctatctcagaattgaacaaatgtacaatcgggttttataccgagacattcagttcccaggggcaggcaggagacagtgcccttcctctatctcaactgcaaggctttcctcttttactaatccacctcagcacagaccctttacgggtgtcgggctggggcacagcctctcatcccatgaggctatatttcagactatcacatggggagaaccttggacaatacctggctttccagggcagaggtccctgcagcttttcacagtacattgtgcctctggtttattgagactagagaacggcgaagacttttaccaagcatactgcttgtaaacgttttattaacaaggcatgtcctgcacagccctagatcctttaaaccttgattccatacaacacatgtttttgtgagctcaaatttggggcaaagtcacaaattaacagcatctcagccaaccaattgttcaaggtacaggtcaaaatggaatttcttatgtcttccctttctacacagacacagtaacagtctgatctctctttcttttccctacaggattgcaggcatgcagcaccatgcctggctaattttgtatttttagtagagacgggatttctccatgttggccaggctggtctcaaactcctgacctcaggtgatctgcccaccttggcctcccaaaatgctgggattacaggcatgaaccaccgcgcccggccatgctaagtcctttcttggctccattgtgctgtccctcctgcttcctctccaggtccatctgccacagtgctacgtgcaccagcgtgccagcaacagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactccctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccataagtctggcttgacaacccattccctcaactgcggatcccggattcccttatcaccctgttgatttctccatagctgtggtaacatttgttgcatgaatggaccgttgaaatagggcctggcagggagaaattcaggaaatgatgaatgaatggttcttccctggcagcctcgatgacttacgagccctcaaggggaagcattttctcctggaccccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacccggcccctgtgttctgcctgccaggccagctgtctcccagccatgctgctggacccccgccaggctcccatgtcatggatgcctgtgccaccccaggcaataaagaccagtcacttggctgctcttctgaagaaccaagggtgagtgccacaggaggaggaggaggacatggggtttgattttgtgcctttcagtgggtaatgaaggctgaaaggatgactttcgcttaactctttcctgctgcaccaaagtagttcacggtatttgccccaagctaagctttccccactgcaggtgtgagatgtggatcccttagcccttggggcagagaccccaggccagttacctctgaccctgggccctttaaatataggctgtttcaatattgtgtgtcctggcttaacctgcatgttctggttgtctgtgtcagctgtgacaggcccttagctgctccatgcatgctcagctcacccctgctctgccctctgccctaggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggtacagggcgtgcgccagggtcgtggagggggggatggggtgaactgctctcttacccagcattggggctgtttctcttgcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacatttctctagctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaagaccctgggccctcaccgcaggcagcagtttgcgttttgaaaggttattgggtcccttcctcgggctgtgttcttgctggtgagcaaaagtgttgcctgcagaaataaaatgcagaacgtactctacgatagatcacagttttttattcttaatgtcacaagcaggagaaaaatctcacattcatactaaaaattccaactagactcaacaggaatgaagtctctatttgtaatggaaagtcccagcctcccgctgccgtccagtgcgtgtactgtacacatccacactcattctcactcagggttcccggaccggctgtcctgcctgcggaactgaggtaaactagctcaggtactgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccgccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgtttaaatatttttttcttttaatttagacacacgcattcatacttctcccaaagaggttgggcgtggcagcaaggcgcttgggctggggtatgtggtttcagaaggacggaaggaaaggatgggctgcagagggccctgtttgggaaaaataggattttaaaaatatggttcattaatttaggttttctaacatctactttgggtgatgtagcctccagtgaggtcagttaagtgggacagaaacggcagagggaagaggtctttgcttcccctgggcccattctccctggctgccagcccttgaagtcagaacaccatgggaaaattcaggagtcggcacttgtagccgtcaagtggtgctactttccacattcaattagcgaggccccagaaaacttgaaacaggaagtccggcactaccaacatgccgccactcatacaactcaactcttcctccaaactcgattcaaagagcaatacacagagcatcagacaaaggaacacaggacaaggcttgaaacatacaatcctggagaggcagacgagggcccaatggggccaaagggtagctgggcgaggaggcagctgaagcagcggtgggcatcctgcctgctccaagagcttctcccttcacccctggctctgccaggctaacagtcttgagccaccaagctctgaggggccaaactggcagagggttggagatgaaacattgattcaggcttggcaggaagaaaacggcaggagcagcacccactggggtctccaaggcaaagctagattcaagggcatttaaaaacgaaggaatcctgcaaggaactggtgagggacacagcagcaagaaatggggaaacagagtccccagaagggaccagaggaagagaaccacttctcacagctaagccaagcaagataaagctttacggatagcccatttcccaaatcccatcaggtgcacaccaccgatccaggcgggctggaccctgccccctccagcgacgacggtctcggggaaaggtggaaggggcgcctgcctaagggtgtgctaagcgggagtcagggcagcggacactatgtacaggtgtttccttagttctccagcctccccagtagaactgttcaagtagaggtcccgggctttggccctccgcatcctgcttccccttccctgaggcttgtgcttcctccagaagggaaagggccccagggctgccactgccccctggcggctgaagccagagatccggggtaggtttgctttacgcaactggaagggtccaaggctcttcctagcaggtgccaaggtccagatttagggaaggggtggggggaacagggacaggggacaaaggctactttttgcgggtgtgctgccttcgggcctgcagtcgctgtcgagcccctggggtcttggatcccgcaccaatggaaaatgaaagggccgccgatcctggaaagattcaacaagacctcatcagggcagctgctacctgagactctgactctgggtgcccaaatctctggaaggccaggccagtaataaaacacagggtgcctcaatagggctttccccgctgcatcagaaacactgtacgggagaagcctcctgaaatgcaaactcccagagagtctcagagcgaggcccaagaatccatttttacctggcttcccatgggaggcaaacttccaccccggacagctcctctctgatctctgccatccaactcccatccctgggttgtgctggactcctaacccgaaatgtctttcctgtgctgaacctgatcttcaccgggcctcagaggaccaggaacctgccaccccgcccaacccctcctcagacagatgagcagggccacagggtggcttgctgcttaccgaaaggtgcaacaccaacaaagccttgggcgggtgctgaggatgccccaaaggagaggctgctgcctgatgtgcccactccaggcgcaggggtgttcagaccaaaggtgggggtggcggtgcctggaatgaagagaacagagagctggccagtgagcagagggcagaggcaagcgaggagccgggcaggagcctgtgctccgcagggcacttcccacgggaccctcagccccacttctgcttctggggcactcctccatcagcagctgagccagacaaccgagtcttcatgcctggtgccccagctcagcctgcttctcccacccgctaatggccacgccagggcagagaaaaagcccccctgccccgcagccacctcgtgggcctcctgaccatcgctgcagaggggagtactctggggcccccgcctcctagcgtacctgggttggctacctcctctgttcaggccttttcccccagccaccgtcccctcccctctgaagcctggtttgtccgtcccgcgtcttttgtgatgccccgtggtcccctcccttccccggccttgccctgactggctctggctgcctgcccgaggccctctctggcagcccctctgcagggatggctgctctcagggcttggcctccggcccggacaagaggaagctccctgtgctcccacgctgcttccacactgtttctcttccttccctaaataccgtaactcaagttcagatcactttaatctgccatgtcctcatgtcacctgtcaactgccaggtcactccctgattcacagaggacccttggctcactggcttccttcccatcaccactcacggtgacttcgccctgtgaggctgactgatggtcctctcagcccctcaaccctgccacccccatgacctcctctccccgacccctgccaccactcctgcagccacactgtcaccacaactgctccggctcccgaatctcctgtaggcaccacccctcctgcagctgacttcacccgctctccactcctgcaccccctgagctgcatcggggcactgacccgctgcccctcctgctgtgcttgctggggtctccatggccgggtggcaccagctgtccgctgaccttaggtctacacccacagtgtcgctgggaaacacatgccatgctaactggcctcactttaacttcacaatcacaattttccagcccacaaactgcctggaaactgatcacactttttaatatgatgttcctttcccccactgtccaaaatgactatttcaaaagacccctttttttatacactttatcctgaccctctctctcccagattttctctacttcacgaagcaaacagaagccatgggatctacattcatcttccacatgggaggaaccatcactgcatccttctgcctgattctgcaatggttttcctgaacacttaagacccaaacacccaaccctggccacaaacaatccttgcctcttggcctccttccacaccactgctttagctcctgccctcctgccatgcttgtctttgttctgctcttcaacataccaaacatgtttctgcctctgggcctttgcatgcgccatcctgggcctgaaaggcatgtccacttgtgctgtgcccacccccatattcagcttacggtttgttttttgagacagagtcttgctctgtcacccaggccggagtacagtggcatgatcttggctcactgcaacctccaactcctgggttcaaaccattcttgtgcctcagcctcctgagtagctgggattacaggtgggtaccaccacgcccggctaattttttggtatttttagtagagacagggtttcgccaagttgtccaggctagtcttgaactcctggcctcaagtgatgcaccctccttggcctcccaaaatattgggattacaagcgtgagccactgcgcccaaccttcagcttacaattgttaactactcagaaggcctttgaccagttaaatccacaatggctcctccagtcattactacgttagcaaaacatgtatcgttccctggcatctcactgagttctatattcagtgcctgtctcttcactgccacagcataagctccccgagaccacaggcttcgcaggcacagcttttcagtgtccggcccggtagcccaagtccacgcccctccttacctccaaacacaggtttgctctcagttgtgctgctcacgttgaaggcaaacggtgtgctctggccggtggtgcccagggcgttctgacctaagccccctgcgaagggggtggaggtggctgtgctcccactctgtcctgctccaaagctgaaagctccggtggtggtgctggagcctggggtggccacattgatcccaaagctcccactgccagcgggggctgccgaacccccaaacgtgaagggtgatggtgttgtgctgccaaacaccgagctgctgctcccgctgctggcggtctgggtggtggctccaaagccggagctggtggctgcaccgaagaagacagcagtggagccgccaaaggcgggctgtgagctggcgggagcgccgaaggccgaagccgtggctttcaacccaaacgccgagtgcgtggcaccgccaaagataggatggatgggcgtaggcacgtacgcaggcacgaccttgatcatggacggaggtgcaggtgtgggtgcagcagccggggctgcagagtttccaaaagtgaaagagctgccaaagctgggggcaagggccggcttggcggcccccggtggctgcccctcagcggccccaaatgcgggctgggggttggctcccggatatgatgggagcggggacttggcgcttgagccaaagggaatgttgaacgtgggggtgctcgtgttactgaacgtcagagtgggctggctgctggtggccggggcggaggtggcgagggtgctgccaaaaccactaaagtcggcagcgctgctgctggtggccgttggcacggcagtgtgcagggactggctgaaggtggtgactgtggtggttgtgggcaaggcaggaggtttgccaaactggaatatggagcccatggccggggtgaagctggcagcagaggcctggggcgccccgaagaggaaaggctgtgaggcggcagtggcggtgctggtcgtggtactcacactgctgctgctcacactgtttatgccaaagccaaacgcaggcttcgaagcagagtctgtggatggactggcagaggtgatgggagccacagcagaggtggcgctggccaggccagtgaagagcggggcagttgtggtgggagcagtggcgggagtagttgtctgcttgaagaagggagcaggcaagggcacagatgcaggtggccccatgctgctaaagacaggctggaaggtcggggctgtggtgctggtggtcgtggggagggaggagctggagggcgctgtggctgagactgaagggccaggcggtgtggggccttccttctcactcttgggtggagccgtgaaaatgggcttgaacatgggaggtgctgaagatgcagcaggggcggcagggctggaaggtgaggtgttctgtgttccaaacaggaagctttgcttgggggcgggggacggggcagatgtggcttggggtttggtagccgtctctgcctgaagggttggaggtgccttggtgtcagtggctggtaccatggatggagcagggatcagccccagcaaagtggtcgggggtttggagtcaaaggaggggctggggagcagccctggcggccctgactgtgataaacccagcgggggtaggaggctgggtgtctttggaggtgagagggcctcagtggttgctgctccagcagattctggaagaagaatagaaaatgtgaaattggaataaacacttcaaagatgatggtattcagtatttcagtgtcctccccacgcctaccacagagcctgggatccaagagtcagtcaataaactcagctaagtctacactacaggcctgtacagtaaatcaaggaagtgttatttctacctcacagatcatcagacagaaggggataaaatggggcctaaatgggggcctaatgtgtagagactaagacagtccaattgtctgaactctgaagttcacgtatgaatctagatatactttatttgcctactaagctcacctgccaggcgctaagagcacacaactatgaatggggaagtctctgcccttgagcagggagggtgcgtacgaaccccaggttaccgtctgataaagaggtgtgcgcgcgcagtgccgtgaaggcctgggccgggaacaccagcagccctcgaagtgctggagggaaaggaagcagtgctgttctggaccagtggttctgacaggcaaggatatcctgaccacgccaccacattcacacttcagaggtgccgcacagggaagatcattctcatctgacagatgaggaaggcgaggctcagggcagctacgagccaggcttcagatcctgagcgtcgcagcaccccttctctaacacttcctgatgcgggctctggcgctgttaaacgtgggcccgctccggtgtgctgagccagggtgcgttcggcctgcagagcaatctccagcgactgacaggcacgacgcccttattccaactcaagccggggatgctgctcagaaggctggatccacggccccactccagctcacctgggcagggtggcaggctcgggggagtctgcatcttcttcaagctctctaacagtgggttggtgcttggggccaggagggaggtgggtggggaggcaggtgcagcagcaggcagggtaaaggtaaatgaaggctgagtgataggtggggtctcagtgacagagttcgaggcagcatctaagaaagaaagaaaggtgaagcagtcctggcttgtctgggacttctttccacatgcctgtcggagagcaggctctcagcacagctcatggaggaatgcctgccctcaattgcagtggtccctgctgtccagttcccgtgaagaccaacacggatatctcaggtgagaaagaccacaagaaaacatggaaccctacttgggattttcccagagaaacccattttttcaaacaccaaaataaaaccaaagaaaacagacacctgaaacctctccagtgtgcaacaatctgtgctccttaccgctcttgtcctccaaggcctggttgaaccactgtaatgaagccttcttctctaagtctaggtcctcggcagtgatcgaatagccaagctggggaggtggaggctaccaaagtgaaaaagaagaagtcaggccaatcagaaaaaacgggaaggctaggcatggtggctcacaccggtaatctcagcactttgggaggccaagccagctggatcacttgaggtcaggagtttgaggccggcctggccaacatggtgaaaccccatctctactaaaaacacaaaaaatcaaccaggcgtggtagcaagcacctgtaatcccagctacttgggaggctgaggcaggagaattgcttgaactcaggaggcagaggttacggttagccaaaatcgagccactgcactccagcctgggtgacagagggatgttgtctcaaaaaacaaaaacaaaaataaattagaaaaaaaatcagaagaaacttgtccttagcgttcctaatacttaggagagctaagccggggagggcaggagtagatggacaagaccataccaaggtcagctgttcccctcgccgagaaggcagcagctgaactttccgcttacgctgcccagagctgccaggtgtagactgagaattcgagttttgtttcttccttggggttgtatctgcagctaaagaaagaaatcaagactcgtttgcttccttccctcttccagaaatggatggttgtgtctacccacttcgcatttcacattgagttttcaatgggtatctctgaaaagattcaatcttctatggtttggttgcttggatggtgtttgcaagattaaggcgcgcacacaaaccgcttactgtgcagtaattactgggatcacccacaggtgactcaaactgagcttacctctatccaatcgttagtccctgtctgtagcctttctccctcatcagactataaacttctgaaggagaggaaatctctctctttgtatctaacatgccttagacatagcaatgctcaagaccttttttcaataggtattaatctctacatcctccacaaacacctccaccaccaacagcagcccctcctcctggctcagcaacctacccttttctccctgggactccctgtctgctgccaatggagttgaagaactggaatgatgacacagctcctcttctctgtcaggaaaaaaggaacaatttagtctagaaaggcttcttggctgaagtattaaataatttctcacaccctcctaactaccaagtggccaatgtctaaaacaaccatcatttaagatctcagtatgccaggataaaaaaagtcaacaggaaattccaacagaatgaagggaggctgttcacagaggccatgaagacagcttttgtcttaaaacaagcacaaaacaataatcttcaaaccttacttacaacctatcaagtccctgggagttctagacacagatgtgatccctgagggagtggcattccagccaactgcaagcacctagggggtcagctcgagtcaagaacctgaaggcgactgcccgctgacttgactctctctgctctccactctgcatggcctctgtgcttgcacccgatccctcatgctggagtgggaggcgacagccagaggccactggagtcagtatccaagactgtagggatgacagcacttcgggtgggtactgcattgtacctctcagggacttaagtttctttgattctccaagtcacagcagcacaaagcctaagagccaggttcgtttcccacctttcctcacccccgcctgtccacgcagcaaatgaaaactgcaggagaatgccaagtaccttattttctttgctggcctctccggtgtctgggagcgggaggaggctgggctagagaagggtgatgaactggggccatttctcttccagagctaaaaatcaagagggacatgactgagcctgctgataacttagcatctgaccctcaacacgacaaagtctcttttcaagtgactaaaaaaacattctttatggttaaatggttagtcatgcctgtaatcccagcatgctgggaggccaaggtgggaggatcgcttgagcccaggaatttgagcccagcctgggtaacatagcgagacccctgtctctacaaaaaaactgaaaaatcagttgggtgtggtggtttgcatctgtggtcccaactactcaggatgctgcagtgagctgagattgccccactgcactccagcctg

SEQ ID NO: 8796 - DNA, 1951 bp, Homo sapiens
acagtgggttggtgcttggggccaggagggaggtgggtggggaggcaggtgcagcagcaggcagggtaaaggtaaatgaaggctgagtgataggtggggtctcagtgacagagttcgaggcagcatctaagaaagaaagaaaggtgaagcagtcctggcttgtctgggacttctttccacatgcctgtcggagagcaggctctcagcacagctcatggaggaatgcctgccctaaattgcagtggtccctgctgtccagttcccgtgaagaccaacacggatatctcaggtgagaaagaccacaagaaaacatggaaccctacttgggattttcccagagaaacccattttttcaaacaccaaaataaaaccaaagaaaacagacacctgaaacctctccagtgtgcaacaatctgtgctccttaccgctcttgtcctccaaggcctggttgaaccactgtaatgaagccttcttctctaagtctaggtcctcggcagtgatcgaatagccaagctggggaggtggaggctaccaaagtgaaaaagaagaagtcaggccaatcagaaaaaacgggaaggctaggcatggtggctcacaccggtaatctcagcactttgggaggccaagccagctggatcacttgaggtcaggagtttgaggccggcctggccaacatggtgaaaccccatctctactaaaaacacaaaaaatcagccaggcgtggtagcaagcacctgtaatcccagctacttgggaggctgaggcaggagaattgcttgaactcaggaggcagaggttacggttagccaaaatcgagccactgcactccagcctgggtgacagagggatgttgtctcaaaaaacaaaaacaaaaataaattagaaaaaaaatcagaagaaacttgtccttagcgttcctaagacttaggagagctaagccggggagggcaggagtagatggacaagaccataccaaggtcagctgttcccctcgccgagaaggcagcagctgaactttccgcttacgctgcccagagctgccaggtgtagactgagaattcgagttttgtttcttccttggggttgtatctgcagctaaagaaagaaatcaagactcgtttgcttccttccctcttccagaaatggatggttgtgtctacccacttcgcatttcacactgagttttcaatgatggtatctctgaaaagattcaatcttctatggtttggttgcttggatggtgtttgtaagattaaggcgcgcacacaaaccgcttactgtgcagtaattactgggatcacccacaggtgactcaaactgagcttacctctatccaatcgttagcccccgtctgtagcctttctccctcatcagactataaacttctgaaggagaggaaatctctctctttgtatctaacatgccttagacatagcaatgctcaagaccttttttcaataggtattaatctctacatcctccacaaatacctccaccaccaacagcagcccctcctcctggctcagcaacctacccttttctccctgggactccttgtctgctgccaatggagttgaagaactggaatgatgacacatctcttcttctctgttgggaaaaaaggaacaatttagtctagaaagacttcttggctgaagtattaaataatttctcacaccctcctaactaccaagtggccaacatctaaaacaaccatcatttaagatctcagtatgccaggataaaaaaagtcaacaggaaattccaacagaatgaagggagactgttcacagaggccatgaagacagtttttgtcttaaaacaagcacaaaacaataatcttcaaaccttacttacaacctaccaagtccctgggagttctagacacagatgtgatcctgagggagtggcattccagccaactgcaagcacctaggggatcagctcgag

SEQ ID NO: 8797 - DNA, 199 bp, Homo sapiens
tcaccccatctgaaaaataaagcctgggcacttgggcttggtattggtggcctttgcaaggtgtaagatgcgttcccctccttgggccccccttaagcttgtcctgtacatttcatttacaaaggactttcacaagcatgaatggaggtgaccccaccacaccccaggtttcggataaggaaaccgaggcttcagtagg

SEQ ID NO: 8798 - DNA, 106 bp, Homo sapiens
atcccagcactttgggaggccaaggggggtggatcacgaggtcaggagatggagaccatcttggctaacacagtgaaatcccatctctactaaaaatacaaaaaaa

SEQ ID NO: 8799 - DNA, 156 bp, Homo sapiens
ttttttttttttgagacggagccttgctctgttaccaggctggagtgcagtggcgcgatctcagctcactgcaacctccgcctccctggttcaagcgattctcctgcctcagcctcccgagtagctgggactacaggaacatgccaccacacccag

SEQ ID NO: 8800 - DNA, 199 bp, Homo sapiens; identical to SEQ ID NO: 8797

SEQ ID NO: 8801 - DNA, 199 bp, Homo sapiens; identical to SEQ ID NO: 8797

SEQ ID NO: 8802 - DNA, 106 bp, Homo sapiens; identical to SEQ ID NO: 8798

SEQ ID NO: 8803 - DNA, 342 bp, Homo sapiens
gtgagtggcaggtatcatgaaccacattgtggacctggagttgctaggaccttttctgccattacacagaaaaatcctccctgagaacacagccattggaggacacatggcagaggaagataagacaataaacagagacacataattatggccagcgtgggggctcacgcctgtaatcccaaaactttgggaggccgaggtgggcagatcacctaaggtcaggagttcgaggccagcctggccaacatggtgaaaccccgtctctactaaaaatacaaaaattagccgggcgtggtggcacgggcctgtagtcctagctactccagagggtgaggcaggaga

SEQ ID NO: 8804 - DNA, 144 bp, Homo sapiens
gagacggagccttgctctgttaccaggctggagtgcagtggcgcgatctcagctcactgcaacctccgcctccctggttcaagcgattctcctgcctcagcctcccgagtagctgggactacaggaacatgccaccacacccag

SEQ ID NO: 8805 - DNA, 289 bp, Homo sapiens
gggggtgctcgtgttactgaacgtcagagtgggctggctgctggtggccggggcggaggtggcgagggtgctgccaaaaccactaaagtcggcagcgctgctgctggtggccgttggcacggcagtgggcagggactggctgaaggtggtgactgtggtggttgtgggcaaggcaggaggtttgccaaactggaatatggagcccatggccggggtgaagctggcagcagaggcctggggcgccccgaagaggaaaggctgtgaggcggcagtggcggtgctggtcgtg

SEQ ID NO: 8806 - DNA, 91 bp, Homo sapiens
gaggctgcagtgagctgagattgccccactgcactccagcctgggtgacagagtgagaccctgtctcaaaaaaaaaaaaaaaaaaagaaaa

SEQ ID NO: 8807 - DNA, 2293 bp, Homo sapiens
ccccctgcctggaagagtgactgctcttctgcgtgctagggtgggagaccttgtggaagtcagtttatctttagagtttcagtttccttatctgtagaagggggtaagaatgcccccagggttgacccttcaggttcatgggatgataagaaaggaaaatggtggacgagaaaggtttctgaggctctgctgtgctcctggccctcttgcttgcttctgccctacctaaggcacagacaagttctctgtgtaggaaaaggattcttgttttccacatgtggtatcttccagagtatcctggaatgtctacatgcccgattagaatccagcattagaatgaagtcagactctcagcctcttctttgggaaacccctgcccatctggtcattggtgctgtgcaacaggaaagactcggggtgctggttgcattgctgcagcaggagagactcggggttctggttgcattgctgcagcaggagagactcagggttctcgttgcattgctgcagtaggagagacttggggttctcgttgcattgctgcaagcaggagagactcggggttctcgttgcattgctgcagcaggagagactcagggtactgcttgcattgctgcatctctcaaaagctttgttttgttgttggttagatttggcactgtgtagtcatggccatgtggcttcaggttctcacaggacacagggacatgtgactgatgaggtttcaagagaggaggattggatgagtgggggattgcagcttccctcctcccgacacctgggaccctccactcacagagagaatgagcttctccagcgtttggaggagagaggagaagatgggctcccctgcaagtccatagaagcctccgtggctttctggattaatgcagccacacactcactccttgcacagcctctgcccagtgtccagttttacatatgctttggaaataagaacaactgtcaataacaccatgacctaaagaaagaaacaagtaagcgctgaaaagcactggggaaagccccctggggctcaaaggagtggaagcccgtgccttatcctctgagccccagctatgacagtgacctcctgtaatgcacaaaaagccctggacttccttctcaggcctgggtctaaccgtaggacttagaaactagtgatcagagggttcacaggcaggcagaggtggaatcctacccacccagggggcatcccctgctcggtcctgcagagactcagctcccagcctgcggcatggcagggaggaaaggcagtgggtggaggtaagtttcacagaagaggcacagagatggcagaagagcctcttagctagagtaggagtaagcaagagggccaggggcgcaccaggaactgtgttcttccgttcagctctcattcccaaaggagcagaaaactctgcagcttagacagaagtctgacctcccaaaagggagcagagcccagccctgaggagccgcctccagctggcgggaagcctgtcgggcatcctgtgaagatgaaggcctgctgcacatcgcccggacctttcaggccatcccggagtgggcagggcttcccacacctgcaggaaccagagcgagactggagacgagctccccgccatgccccatggctcattctagaccaggattgattgacctctgccggtttaaaagggcattttttttttaagcctcaaagtcaaaactcaagtatgagcccgtaaaaaagtaataataataataagcactatctatggaaagcaatcctgtcctaaagattttagggcagaggtagctctgaaaatagatctctgcagtaaacagacaatacttttatagaaagtgtctgcttgttggtgtcacagagatggactgcatggccgtgacccaggagccaggaacccaaggtgaggcaggacctggaacgaaggcagacatccaagggttttctgaatgaaatagaagatggatacggagacaccaaagatgtaaaagtagagtttagttgtgtattgggagctgcaaataacataaatataactgcagaaaatcaaaacagtgataaggagactaatcttaaaaccaagagataattcacagaaaaaaaaaaaaaaaagcaaggaaatggaacaaaacagataaagagaagttggtagatctggaggacagaggatgaatatctaactgaagagtcgtggatgctcctgagggggaacctcaatggctccagcagaaggaagaatcacattagagtgaaaaccatagtgttggaaagaaagttactcga

SEQ ID NO: 8808 - DNA, 5566 bp, Homo sapiens
ctgctcctcctgagctgtgtagctgcctgaaggaggccaggacctgggtaattaattactagagaagcctctggtctagcagcaaaaggaggtagttaatttagcctgcctgttaacaatagttatatttgtctccgattccattagagatgcttaggaaaaggtttttatatcctgaaccctgatgtccattttcttaatgcaaaggcctgtacttggggtcttgtaagccccctaatgtcactctttgaagtgaagtaactatacgtgataagtgaataaaatgtgtcagagtgtactacttagaattttcatagattgtaaagattttctatatatttatttgaattggtaattggttatgagcagtttggtgtagctgtttttaattgtacaacaattaagatatcacctatattctcgaagaatgggatcattccttctaggtgagggattatccctttaatatattttctttctctttgtctttgtttatggtggagaataattaaacttttttttttttggaggtaggtcttgctctgtcacccagattggggtgcagtggcatgatcataacttactgcagcctcagccttccaggctcaactgatcctcccactgtagtctcagagtagctgggactacagccgcacaccactatacccagctaacttttttgttctattttttgtagagacaggtcttggctatatccctcagcctagtcttgatctcctgggttcaagtgattcttccgcctcagcctctcaaagtgctagattacaggtgtcagccaccagcacttggccgtcttcctctaatttttaattttttcactttgagaagcctatgatatgacatggaatttgatgtctcatcctgtgtggtcctgtgcaccctgttcctacagaagtacagagggaatcttttgagagggagggataaacttagattcttaaaaataatgcatgtgggtttttcagtgttcattttagattctcttcaaaacagtcagaagccccctaccctaatctcaattcctgtctgctccctcctggctccctgcagtaaccccttctccacctgatcttcctgctgctgctctttgtcccctcagagccgtgtgccacacacaagccagaaccatcatcctaatgagcaaattccccaagtccttattctgccctgcacagtcgggctcagttctctgtccctggtctcccctagactatgccacatcccttcctgcctgagaacttttgcacctgcgcattcctctgcctggaatgtttcttgctctcatttgtgtcctcaatgcccgtccccaagcctcactacagcctacttacactgagggtttccattcaaatattaccacccaagtggccaggcacggtgcttcacgcctgtaatcccagcactttgggaggccaaggtgggcggatcacgaggtcaggagatcgagaccatcctggctaacacggtgaaaccctgtctctactgaaaatacaaaaaaattagctgcgcgtggtgacgggtgcctgtagttccagctatttgggaggttgaggcaggagaatggtgtgaacccaggaggcggagcttgcagtgagccgagatcgcgccactgcactccagcctgtgcaacagagcgagactccgtctcaaaaaaaataaaaataaataaataaatgttaccgcccaagtgagctttccttgcattgattagattcggtctccccaagatgtgctttcatacagagcactctggactcatagaacttacacctgaagttgtagtgaacttggcttcccctgctgtcagctctttgaaagtaaggctcatttttaaaattgtatccccaggacctagcatagctcctaactcaaaataggcactcactcatacttgtttactcagtctttttttttttttttttcccctcagagatgagatcttgctatattgcctgggccagagtgcagtggctattcacaggtgcaatcatagcacactatagccttaaactgctgggcttaagggatctttcccaggtagctgggactgcaggcatatgccactgtgcccagctgctcccttagtcttgactatgtatttttttttttttggttgttttattaggatagagtcctaagaatggcattactgggttaataggtatgaacattagatctttaatacatacagtcgaattacttttcataaagccatatacctttttatattcccaccgatactatccctatcactaagtattaacttattttcatctttgccaatatgatcatccaaagtgaggcagtgggtggccatcagatgtctgagtcagcagggtgtggtggctcacgcctgtaatcccaggattacaaattttgggaggctgaggcgggtggatcacctgaggtcaggagttcaagaccagcttggccaaaatggtcaaacctcgtctcaacttaaaatacaaaaattagccaggcgtggtggtgggcgcctgcaatcctagctacttgggaggctgatgcaggagaatcacttgaacccaggaggcagagggtgcgggggttgcagtgggccaagatcgcatcactgcagtccagcctgggcaacagagtaagactctgtctcaaaaaaaaaaaaaaaaaaaagtctgagttatgaaaacagaaggctcgaaccagccccttgatctagttattctgggcaagcctacatgtgtcctcgaaggtttctgggctctcaggttttacagccttagcaggctaaaggcaacagggaggacagcttgtcttatctgttaggcagtagttttagtaacatggccagcatggttacctgtaagagaggaccctgcttgattgagccacatccagctgtccaaatgtatgtaattaccatttatcattgaaacatatgacagctccatcaaaagagagcaatgtgtagtctggcagaggacagtaggattaaacaagaatggcttcttttatttaaactcaatgaaaatacaagagggaaaattactttgcttactataccctctcacctgttataagctgttctacctttaggttcttgccctattcctagactatttgaagttgtccttttttctagaacgtccacacatgagttgaattttccatgtcagccatgcagctaatttagaaacatgttgctgggttgggcgcagtggctcatgcctgaaatcccagcattttgggaggctgaggtgggcggattgcttgaactcaggagttcgaaaccagcctggacaacatgggaaaaccgcatctctacaaaaaatacaaaaattatccaggcgtggcggcgtgcacctgtagtcccagctactcaggagactgaggtgggaagttcacttggcctaggaggcagaggctgcagtgagcagagattgtgccactgcattgtctagcctgggtaacagagtaagaccctgtctctaaaactgaaaagtaaatagaaacatgtagcggtgaattctgtgtccagctcaaaatcagcaatttcccttatctcacttttttacttatttcctctttatttacacacatagctcccttagctcataaacacttctgagggcagggaccatgccttttattcttattcccttttcagcttcctaacacaatgctttcagtgtagtagacacttgaacaatatctaaagtgcaattcaaaggggcagctactgcaagtcattatgccagtctagtaatggtcagattacaaatctgaggtttttataccttcaccccctttctcaacttttaatagtaaacagaatagggctgggcattatggctcatgcctatagcccagcactttgggaggctgagatgggaggataccttgagaccaggagttccagaccagccttggcaacatggtgagaccctgcctccacaaaaaaattttaaaagtagccagctgtagtggctggcatctgtagtccgagctatttgtgggaagatctgagacgggaggatcacttgagcccgggaggctgaggctgcattgagctgtgattgtgcctctgcactccagcctgggccacagagcaagacccctgtctcaaattttgaaaaagcggttaacagaacagaattgtttggctcttttatagttttcttcttccaagtagttggtagaatttggatactttctgccccataacaaatgtcactttatataaaggagcatgtccttaatgcattccaaaagacatatacaactgattttaggctaatttcagtctgagtcctggtagagaacacctgacacacttaaattgagaggattttaataatgagactatttgcaaggtgttgactccagctggggacctccacactcagcccactcaggctaagtcttggttgcgcaccagctcagctcatggctgggctgggtatgccccagctcacctgtgttatggcttgttcccaggttcagcagttcccaaggtcttgtcctgtgtctgagaagaatgaggttacactggcaatttaagggtgaggagggtggagaagaattttattgagcggtgaacagctttcaggagcggaggaggtagtggttccccacccctgaagtctggtggtttctctcccagtgtggctgggtgggggcttttatgggctcagaacaggggcatgcatgctgaatggtttgtgggcatgcaaagaaaggctaaagcaaaggcaccactcaaagatgggcatggcagtgtagaaaatcaattcggaaagggtaggtagatgtaaaataggtgaagagtggggatcaatcagaggaaagcctaccaaatgggaagatgggttctcagtccggtccatggatttgacctgtagtgtggctttcaggctttcagttgtctttggcttagaggtggggtttcactggagacccgcccctgtgaggcatttgtctgcctcctgccgctatcagtgtgggcgaagtttctctagaaaccacagggataatgcagtgtccacagctggtaatcaggttaccaccatgaggcctacgacagggagaaggaagggggaggagttgcccaaacctggagaaggaaaggacttactttcaattgagagtccaagactgtccacagacactctcagggtgggagctgggagaatgaatgccctgacctgaccctcccttcgtctgaccttctgcaggcctccccattgattaatagcactgggagccagagagtgagggagcctgttgatgtggttcttacagagccaaaaagtcagagcaggctgggcacagtggctcatgcctgtaatcccagcactttgagaggccaaggtgacttgaggttaggagtttgagactagcctggccaacatgatgaaaccccgtctttactaaaaaatacaaaaattagccaggtgtggtaatcccagctgcttgggaggctgaggcaggggaatcatttgaacccgggcggtggaggttgcagtgagccaggattgcaccactgcactcctgcctgtttaaagagtgt

SEQ ID NO: 8809 - DNA, 486 bp, Homo sapiens
ttgagctgcatggttccgcttatacacggatttttttcagtctacatgtgtgtcaaaaagacagtattcacaggatgcacagcccacttacgcagagggccaactgtgggacttgagtatgcacagatttgggtatatgcaggggtcctggaaccagtcccccatgaatacaaggtacaactgtgtcttttttttttttttttgagacggagtcttgctctgtcgcccaggctgaagtgcagtggcgcgatctcggctcactgcaagctccgcctcccgggttcacgccattctcctgcctcagcctcccgagtagctgggactacaggtgcccgccagcacgcccagctaattttttgtatttttagtagagacagggtttcactatgttagccaggatggtctcgatctcctgaccttctgatccacccacctcggcctcccaaagtgctgggattacaggcgtgagccactgtgcctggccaa

SEQ ID NO: 8810 - DNA, 1369 bp, Homo sapiens
gagcagagatcgggcttggtgttttggggggtcctgggtaggtgtgggaggcctcgtttcgggggccacggggctcctgtggcgtgagactccatcacagtgacctcctgtgcccaatagctccgtaagggcagggtttgtggaaggaaggagtgagtgaccgggaatggggtcttgggctccagggacagccatggcgagggctcttctgtgtgggtgcaggtccggaagctggggctgtggttggtgggggaggctgggtggggctgcttcccctgcagaagggctcttccgggctcttggcgcggtttcacgaggcagtcccctctgtgtctctcgtgccccctaggcctggatcgggttctcaggaagcctcggggaagtgagggtcttagcgccttggtttggggctgggcactttgcgagctggtgtcatggaggccaaactgggggcctccgggccaggtggtggcttcaggcttgctgttgggacaggaggccaggctaggcagtgacgcctcactgagctccatgggtggcacgctgagctctgggtgggagaggcctctcccactgacctctctgtgactggcttctctgctggtctgagtgggaagggccctcagagaccctggaggcctttcctgccctggaggagtcaggcccagagagggtgaagaattgcccgagtcacacagctggtgacagggagagctgggactgtaccttacatcacctgacattcagcccagggctctattccctgcactgtggcagatggggaaactgaggcaggtgggccactcctctgcattccatgggagaggcaggaaattcgacaggagccctttgccgggttggcacttggagctgttttcctgcttgcttttccccagggcaaggtgcttcccagctgaaaactgcctagggagggtgctgttgagaccgtgagcacctgagagccctggtctttcactcaggcctctcctctcacctccacctgggaggctaagctcagggtaggtgtcctggcccacaggcaggtgcatgggctggtcccgccagcacctgcaaccttcttgtgcgcagctagcccaacctggggtcaggtggaggtgggtaagtggggcccccagcattaaagagcttcataggctgtcaattaaggggaggctagtgggctctacaggccacagctacccagggagccttcttaggggaggagttcctaggtgggtctcagagactccaaagtcagcatttcccaaaggaggttcattagggattcagtgcaaaaagagtctcattaacaaaaggatggggaaatgttcagctgtgtttaattcagcaggcttctttcctgcaggac

SEQ ID NO: 8811 - DNA, 1369 bp, Homo sapiens
gagcagagatcgggcttggtgttttggggggtcctgggtaggtgtggaaggcctcgtttcgggggccatggggctcctgtggcgtgagactccatcacagtgacctcctgtgcccaatagctccgtaagggcagggtttgtggaaggaaggagtgagtgaccgggaatggggtcttgggctccagggacagccatggcgagggctcttctgtgtgggtgcaggtccggaagctggggctgtggttggtgggggaggctgggtggggctgcttcccctgcagaagggctcttccgggctcttggcgcggtttcacgaggcagtcccctctgtgtctctcgtgccccctaggcctggatcgggttctcaggaagcctcggggaagtgagggtcttagcgccttggtttggggctgggcactttgcgagctggtgtcatggaggccaaactgggggcctccgggccaggtggtggcttcaggcttgccgttgggacaggaggccaggctaggcagtgacgcctcactgagctccatgggtggcacgctgagctctgggtgggagaggcctctcccactgacctctctgtgactggcttctctgctggtctgagtgggaagggccctcagagaccctggaggcctttcctgccctggaggagtcaggcccagagagggtgaagaattgcccgagtcacacagctggtgacagggagagctgggactgtaccttacatcacctgacattcagcccagggctctattccctgcactgtggcagatggggaaactgaggcaggtgggccactcctctgcattccatgggagaggcaggaaattcgacaggagccctttgccgggttggcacttggagctgttttcctgcttgcttttccccagggcaaggtgcttcccagctgaaaactgcctagggagggtgctgttgagaccgtgagcacctgagagccctggtctttcactcaggcctctcctctcacctccacctgggaggctaagctcagggtaggtgtcctggcccacaggcaggtgcatgggctggtcccgccagcacctgcaaccttcttgtgcgcagctagcccaacctggggtcaggtggaggtgggtaagtggggcccccagcattaaagagcttcataggctgtcaattaaggggaggctagtgggctctacaggccacagctacccagggagccttcttaggggaggagttcctaggtgggtctcagagactccaaagtcagcatttcccaaaggaggttcattagggattcagtgcaaaaagagtctcattaacaaaaggatggggaaatgttcagctgtgtttaattcagcaggcttctttcctgcaggac

SEQ ID NO: 8812 - DNA, 408 bp, Homo sapiens
gctgtgtggcctggctggggcaaggtgggctcctgtggactggatggtggctgcagctgcccccgtggggctcataccaatgccatgcccattccgagtaggcatgtgtttgctcagaactgaggaatctgatttttgtttctgctttttatttgtttctcagggggctggggtgtctggattctctgctaagtgccagtgaccttgaacttgagtggctaggtgctgtgtaggcagagttgtcacaatggaggaggggacagagaaacgcatccacccccaccaggttgctcaccacagggccagcgcgctcttcctgctctgggacactcaccgaggctgaattccacgtggctcccgtggctaggcagatagatgcagctaagggcttaaaaatgtttctatccc

SEQ ID NO: 8813 - DNA, 293 bp, Homo sapiens
ttttgtttttgagacagagtcttgctctgtcacctagcgtgaagtgcaatggcataatcatggctcacagcagcctcaacctgcctgggctcaggcgtcctcccacttcagcctcccgagcagctgtgactacaggtgtgcaccacaaccccaggctaatttttttgtattttgtggagatggggttttgctacattgtctaggctggtcttgaattcctacgctcaagtgatccacccacctcagcctcccaaagtgctaggattacaggcatgcaccatcatgccctgccc

SEQ ID NO: 8814 - DNA, 869 bp, Homo sapiens
acacacacacacacatatatatatacacacacatatatatatattccatggcccactctccccaacatacaaacgtatgcctccaagtcccttggggtggtgttgcgggtccatatggtggctgtacagacagtgggttgcagcacagctgaagaactgacctggcatcttttcagcaagcagtgaacacacgagtccccctactccagggatgggcagttgcatggcagtcatgctcaggtgccctgatctacttagtggcctatgtgaatagttacaggacctgctcactgttacaggatgataagccttgaagtttggcacacttagcaaggactgacaggaacactcagcacccatggcagactacctttcctaacagagacatagagattctgcgaggtctaactcacatatacttgtattccaaggatacaagtggaggacagaaatgaggcagaagtgataagttgaagagcacggccaagaattttccaaaacaggtaaaaatcatcaaaccacagttaaacaagaagacttttggaggctggtgcagtggctcacacctgtaatcccagcactttgggaggctgaggagggcggaacacgaggtcaggagatcgagaccataccggctaacatggtgaaaccccgtctctactaaaaatacaaaaaaattagccgggcttggtggcgggcgcctgtagtcccagctactcgggaggctgaggcagaagaatggtgtgaaccaatgggagaagaatgggagaaccaatgacgggaagaatgggaggcagagcttgcagtgagccgaaatcgcgccactgcactcgagcctgggcaacagagtgagactccatctcaaaaaa

SEQ ID NO: 8815 - DNA, 866 bp, Homo sapiens
atacacacacacacacatatatatatacacacacatatatatatattccatggcccactctccccaacatacaaacgtatgcctccaagtcccttggggtggtgttgcgggtccatatggtggctgtacagacagtgggttgcagcacagctgaagaactgacctggcatcttttcagcaagcagtgaacacacgagtccccctactccagggatgggcagttgcatggcagtcatgctcaggtgccctgatctacttagtggcctatgtgaatagttacaggacctgctcactgttacaggatgataagccttgaagtttggcacacttagcaaggactgacaggaacactcagcacccatggcagactacctttcctaacagagacatagagattctgcgaggtctaactcacatatacttgtattccaaggatacaagtggaggacagaaatgaggcagaagtgataagttgaagagcacggccaagaattttccaaaacaggtaaaaatcatcaaaccacagttaaacaagaagacttttggaggctggtgcagtggctcacacctgtaatcccagcactttgggaggctgaggaggacggaacacgaggtcaggagatcgagaccataccggctaacatggtgaaaccccgtctctactaaaaatacaaaaaaattagccgggcttggtggcgggcgcctgtagtcccagctactcgggaggctgaggcagaagaatggtgtgaaccaatgggagaagaatgggagaaccaatgacgggaagaatgggaggcggagcttgcagtgagccgaaatcgcgccactgcactcgagcctgggcaacagagtgagactccatctca

SEQ ID NO: 8816 - DNA, 104 bp, Homo sapiens
ccagcactttgggaggccgaggcgggtggatcacctgaggccaggattttgagaccagcctggccaacatggtgaaaccccgtctctactaaaaatacaaaaat

SEQ ID NO: 8817 - DNA, 6486 bp, Homo sapiens
cccgcgccctgtgcctcctggggctacctgaagccggtgtcctgggagatctgtgagcagttggtatctgtggggcagagagaaacggggtgagagtggggatggagtgtgggattcgatgtagaagacctgcggctgggacggggctcccccagtgttctcattgacttcaaagcaccagacagcaatagctctctatctctagccccctcccagtttctcctccccactacaaggggcagacctacaactgcagaggaggccaaggcagggcgggcccagtagggccctaccattccagaaccaacaaataggttttgtccaaccgcaactccctccctcaccccaaggcctctgcccctgtcccccaccccgggattggcccctaatcctttcttcattccatcccttctccctccagaattttcagctgtgggttctctagctcagaacactttcccttcccaggggatttcttctcctgaacaactacttcctgagtcctcttcttcaccccaacacgggtcatttcctatcttcccccacacgctgtccatccccactatagctgtctcctggaataatctcttgcacctggctacacccgagcactgctgagacgatcccacttctgctcccgtgctcacagcctgctcaccacaacgtctgtgttgacagggtgtttctgcccggagcccccacccagcctccaacactgtttggtacacagaagccatggcaacggcccccacctcatcccctcctcccacgcaagctttggagcttcctgtttgtgtagcctcagctttctcttctgctcctgactctcggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgaggtaagcttccagcccagggtctgggtggggccgagtgccttgcgtggcccctccccgtttcccgcctattgtaactccagggtgagggtgagggttgttctcacagctgcagtagcgctagggtttaggttgctccctgccagtccatcccccaggttgttcagctgtcaccttcctttggggtccccagctctgggggtcccccacacctgtcttccagctgggcatatctcttctcaccctggtaggcaacttgcttactgttttctttatgtttgagggaaggcaggggcaggtcccctgggtgtccctagggtgggccttcccagctccagcagccgcagcccatcagcttctgcctgcccgtgggggtggggaagagaaacagctgctgaccaggcctggcctggttggaactgccccttctcaggaccccgccctatggctctggcacctcagagcttgagggcaatggccccagagtggagcagatacactgcagctggaggccgtgaccctgccagctgtgtccaggccccagcgttgggcggtggagggggttcctcagcatccactttccacccagtggtgggtctgggaggccaagtttgtcctgccttggggggttggggggcactggaagtgtctggcttcaggcctttctctctgctcttaaccccagtgtctaggttaatcattctcctgccctttctttacctgtgccatggtgatccccgagcctcaggccacttggtccctggaaacagccctgagcacagccactcccaggagagaggtctggaactgggctgcggaaagggggcttactggtggtagtagctcttagccccttcctcttcctacctgtcttccagccattcccctgtgcatcagaggttagaggtttctatggtggagtggcctctgggaagggcagggatgcttctcttggtttctcctcagaactcagccaccccaccccgcctgccttccccaagctgatggtgtgtgtgcctggcgctgtgggtcggggcccagactgacatttatctggcccagctttcgggctgggggaagtggagggggcgggttgctcttaatgaggtttaaaaataactgatttaggggaggatctgctggaaatgtgcagcttgataagctggggtaaaaaggagcagccatgttggagtcgggacgggagggactggcccaagacacagcctctgcggccgagaggtgttgagggtttgaggcaggctggtccccttgtatttcgcagagccccaaggtccattgagagggggtgacgggattgtttaacctgggtgtgtgggagagggggagctggagtgacttcatccctgaaggccaacctggcctggagccagatgtggttagaaggggtggctctctttcttccccttgaacgcagatgcctgtcctgggggtcccctttcgtgagcagcctgacagctagctctgttttggagaagagagaaaagccaaaccagggtggggatgggacagaaaatggggactgtggcccattcttggttcttggctccccttggcatccataccatgcccgggtcttgctcagcccctgagtgtcagacccaggtggtgagtgtggtgggaacacactgccacagtgaggtccgccaactcaggccattggtcgggaaaccacccagttcttgctaatcaagctcctccaacgaagttaaagaaaccctcctgtgtatttccccgtcttgccttctcttctccaggtttccccaaaaatatcacccagggctcctgtattagtttcctatttctgctgtaacaaattgctacaagcttagtgatttaaagcaacacaaatacagcatcttacagttctacagactcaacaggggtctcactggctaaaatacaggtgttggcagagctgtgttccttctgggggtttttgggtgaatctatttccttcccttttctggcttctggaggccacctgcattgcttggttcatggccctgtgtgactctgacttctacttccattttgttgttgttgttacttctcccactctgactcacctatctcccactttcagttagtaaggcccttgtgattacactgggctcatttagatgatgcaggataatctccccatttcgagatcttaatcacatctacgaagtccctttttgtcatataagataacaatatccacaggttctgggaattaggacatggacaccttttgcgggggcatgattctgcctgtcatagctcctagaggggaaagtagaatttgtttttattgcctggtttttcataggaaattcgatttgtttgctgaaatccctcaaggacctattcaagcctacctcttccagaaagccttcccaggctgcttctgcccgtctgcttcttttaactcctacaacatgtgatctgaactgtgcactttagtattctttgtgtgcaatccttacctgttcatatgtactcactttgtctccctgatggcactgtgggcacttgaggaccaaggacttctactatctctttcacaatccctagcacagatagtaggtgctcaattaaaatccagtggtttgcaccaacctagatggttaaaaaaaaagcaaagaaaacccagaggttgagggagggtagatccaaccagtttcctaagctgttccacattcctcctcctctccccaaatcattctctttcccagggctataaagagcagggttgcatttggtaacagttctggtcctcatccttggggctcaccgtgggggaaatggtgtatatccctgcaggcagaattcctgaattccccactccccaggctgcaaggtgttgaccaaaagcccgggtgtgtcctctccctagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgagagccgggccccactggcttggaagtgcagggagagcaggactgggtccagtggactggggattgtttaacctgaagaggagaagactgaaggcacacatgtcccagcctcttcctcagcttgaaggcctttgtcaaggatgtgagagggcccatgctttcctcccttcccgtggagtggagggtaagggtgaatgtgcctcccaggcagtggaagactgaggtgacactgaggaagaatgtctctaaggaaagaactgtgggagggtatattagcaaggaaagactaaacactggcttttcactctgggctcggaggaaggaggctggcaagaaggactgtgaggcttactctagtgaaagagtccaagctgtcttcaggcaagacaggagcctctctggttcattgtctctggttctgagggtggtgtacgctgagctgcgataggtaggcatattctcacctttccacccctgctgtcctcatccaggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggtgggacagggcgaggggctgggtcctgtcatccaggaggccagagattgggctgggccctcttgaccaggcagaaggggctgttttctggctccctgcagagaaagaggggtgtgtttgtgttccatggagcacttggtcatattggaggctggaatggagaagggtatggaaatgaacagtagaaataattaggaagccaggcctgctgacttagcgatagaggcggaaccctggtatctaggacactgcggaggctgacacattcccattctccttcccaggaaagaacatggcctgtgtgcagcggacgctgatgaatctgggtgggctggcagtagcccgagatgatgggctcttctctggggatcccaactggttccctaagtaagtattgctgggacagccgcagggtccagcaggtgcattgtttctgcccaatcctgtccctaggaaataacttatctcagtagcagctggccctttacaaagcactttcagaaaattcctcatctcacttaatcctcacaacaccctctgggatggcaaatgactgtccctttggacagatgaggaggtggcttcagagagcttatggctctcgagggcagagctggcaccagcccttgagccaacagcaaagcctgtgctctgtccaaggaagggatttactagggcagcctgtgatctcctctaaccaccactcccttgtcacccaggaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatggactctggctgtgtctggggccactgtgccactgtggggaagggaggaata

SEQ ID NO: 8818 - DNA, 643 bp, Homo sapiens
cagctgcaagtctggcatgggaagtctacagaagatgaaccaaatagccacaaagtctctgagctaattttgaaaggtggggatttgggagtaagtggggactgggagagctggtcagggtgaggaatggctgccagggggctttgaatgcacttgtttgaagtttgtatctgtaccagcagctgtggaatctgcatgccatgaaccagttggcaggtatagacaatgaacctggcattatgaatagcaaggttgggagcaggtggggaaattgggatttgagaggccagcaagcaggagtttgcaatgttctgaagggttttggtgattagaaaagaacaggtcagctgggtgcagtggcgcatgcctataatccctgcactctggagggccaaggaggcaggttgcttgagtccaggagctcgagaccagcctgggcaacatggcgaaacctccatctctactaaaaatacaaaaaaatatatatattcaggagtggtggtgcacacctgtagccccagctactcaggaggctgaggtgaggatcatctgagcccagggagttgagactgcagtgagctttgatggccccactgcattccagcctgggcaacaagagtgagaccctgtctcaaaaaaaaaa

SEQ ID NO: 8819 - DNA, 2779 bp, Homo sapiens
tttatttttagaaaaacagagcaaagtttattgaaatttcaagctacatttggaaaatcaaaatccaaatcctggaaccatacatcaggataaggtgtcaaaaagtggaaagtgttcactctcacaaaacccgctacagacaagctttctgggcacacctcccaggctccattggatcaaagccatccccttgttcatccctcatccacagtaggacaccatccttctgttcacttgaaagttttccacaataattacaaaacaaaacaaaaaacgttttcaaatgacactgtgaagcccaaactgatcttctctcaaccccattctatgtagtcagcaccagtgaatggtgggtttggcattcaaaacaggacttcacgtttcagtggacagctggggaaagggttgcagcagcaaggcatccgtggccgcattcagaggctggcccccctccttgcctttactctcgagtcttacttaacctaaaagacaaactgggtcaacttggtaaatgaacacagtcaaagacttagccataagaggtaagggaccagtcaatactcccaaggctggttaggcccttcaacatgtaggtggatgtgtatatgtatacatcgctacactaagatacagatctagccctatgggtatatatacgcatttatggctatatagaaaaactatgccaatactaaccaaacagaactttgtaagcggtcatcccaaagctgtaatcccacactgggctgtgcacaaagccatgcattataccatattaaccaacagaaggctgacttggctcaatctctcccatctgtgtcccctgccttcacgaaacagaggagaagagagaggttgcctctgcttaaaacacaagtggcttcttcataggaacagtcgttgtcaggtgaagctgttgaagatgtccatggagatgagaaacagaccccttaaactttctggagcaaactggtgtcacacctcaaactacccttctcctttgccagttgcagctaagttgcccaggccctgggagcccccagggcgcagtagcattagaggctcactggcttggtgttactaggccccatgcaactcagcctccagagacctgctcttgtcaggggtctgtcgctggagtggacccaggtggccatgtccttaggacatctcttggcaccagctgtgctaggtgtaaagttctcctcgtgagatgatgcttggggagccaaaaacaaactggaaagaactaggtaaaacaagtttagtggctctgcccaccctgaggacagagccacttacaccgcagaaccaccaggggcctcgggcacttgtggggattcgggagctggctcttcagggctcagacaggactggaacttctccagctgctctgggcttgccagggtcttcaacagggtgttctcacgctctagctgggagttcttctccaccagctctcggatctgctccttcaggatctccacctcctctctcacagcatacatcagatgattcttcaccagatcctgccaatgagggaatcataacaaagccattccttagccatcgtggcccctctgcagcacctttgctctgtcattggtgtgcctgtgctgtccttaatgccagggccctccagccttccctcagtgaactggtctggcaagtccaattcctcgttcacctttctctgaagcacttaaaccctcattcaggagagctacatgatttggcttatgctggagttgagagcccagctttgaactagataggttctcccctgcaagtttctaatgactttcaaagctggctgctgaggggcctttggggtgacacttctgctgtttgccagtggtttgctatgtccccctttttacataagcccctactgctgccgatccagatctgggggaagggtagacctgcaatgcatcccatactgtttgtctgctgtacaaatcttaaccaagagaataaaattggctattttagagtctcctcccctccatatgacccagcacattgaattgcagctgtcctgcagccggccagttagcacacaggacattggccttggggaaaggtacagaactgccgcatcctctctgaatttgatgactgcactgggggcagggaaggtgtccttaagctccagggcacaattaagtggctcccaaccgctgaagccctaaccctctgcagccattgtggctgctccttggagtatgacctctacctggtaaggagagggacaggggtggggtgcttcgcttcctgtttccacccaactcctgaccccagtccaggctctgcagaggcactgcagtgctgttgcatccaatgagctcagccccttgccagctgcacgatgcacacaaatgcaagagtctgagctccctgcccaacaacaggcccaggagagagtcagagcctgcggcaaagacctgagatggaggagggaggaagaaaggagggagcccaggaagggaagactggaaatgccctaaaaggtgccactctaatcagactccacctccagtgcggataggaggcaggctgtcggcttcctcagggttttggctaagggctttttcacccattccctcaatcctgcccagagttacataagcagcagctaagtcaggggatgagaatgacgcagtgatgccactcaccatggcctgttcgatcttgttgtctatggccaccacgctggctccggaggcactgccaagacaaaaagcaaagcgacccattacccactcggttctactct

SEQ ID NO: 8820 - DNA, 165 bp, Homo sapiens
tttttttttttaagacggagtttcgctcttgttgcccaggttggagtgcaatggtgtgatcttgactcactgcaacctccgcctcctgggttcaagcaattctcctgcctcagcctcccgagtagctgggattacaggcatgcgccaccacactcagctaatttt

SEQ ID NO: 8821 - DNA, 304 bp, Homo sapiens
ttaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaa

SEQ ID NO: 8822 - DNA, 133 bp, Homo sapiens
cccagcctctctgtgtcttatgataaaaaaaatactggatgagacaagactgaggaggaagacccagggaccctttttagcagagcttaccagcgggtgtccaaggattgaatttcccttcctagacatgttt

SEQ ID NO: 8823 - DNA, 10474 bp, Homo sapiens
atattattgtggttcaggacagaagacttagtagcatgctcacttaagctaaaacctttagcaaggtttctccagttcccctcttaagaaaattgaaagaccagccaaaagaatcaaagggaaacacgttgagctcttaaagctccagtgcatttaattccttagaacaccacagaatcatggcagcttttcatgatgccagaaggtaaagcacgggggaatacagaggtggagtcctgctttttttcaaatcctaccttctattacagggaataaagaagagagaggcaccagcttcttctcaaacaaaggaactgagtgtaactatattaaaattttagcattttccaataaagtttattcaatcttctttaattagtgatttaagatggtctaggtgatgctctcctatgaaggattctgcttgattcaaagcttttattttcaccaaaataagaattatttcttcgacttcatccctgaaaaacaaaacaaatttctccctttaaaaatgcaatgtatgagggaacagcggtcaattcagaacctgatcatcagttgttaatctaaaacaaaagctttaccttaagccaatatctaaagtagcataaaacacagagagatgctgccatctccacttaattataaagttcaaatacagatcattagtggatgtattctggcaaatttcaatgtgaattactgtaaaaggtagaaaagcatatagtaagtctatcagaaatttcagtagtgctgcgttgctattagcttgtatgagacattgtggtggaagcaatggtgggagtatattcacacatcatgacattagcaaataatacaaatctgattttttttttttttaaagggacttggtcttggctctgctggtcagactggagtacagtggcacaatcatagctcactgcagcctcaacctctcaggctcaagcaatcttcccacctctgcatcctcagtagctgggactcaggcgcatgccaccatgcctagctaatttttaaattttttgttctagagacagggtcttgctatgtttcccaggctgttctcaaactcctgggctcaagtgatcctcctgcctcagcctcccaaagtgctaacattacaggcgtgagccaccatgcccggccaaatctgggcttaaaaattttttttggagagggagttaacaggaataccactgtatttaagcccccaaacagctggtgctgtgaacgaaacattcagaacagagagctagctactgctggataaataccaagctggagacctgtacttaacaactgttgagtctctaaaaatggacaggaaaattaaaaacacatttaaaaagtgcttaataaaatgtttttgatttatagttttaattctatattcccctgtgctatagttttttgaatttgcttaatttgggggagatttacattttaaaatatggatatgcataagccatcccaaaggtaaccataaaaatatctactaactctacaaagttttaacaaatttttaaaagtacagtaaaaatacaaatctttctaaaagttgttgagagcatacagaatccatgaactctctttatagaagtgaaaataaaatatgcattacctgaattcacttctagataatttatgtgcagactgcaataaaaactgaatgaagttttctagctgtggaatagatgtcctcatggcagaattttcaaaccatttttctggtagacatgctgctacctgttaatcaaaacacatggctggtttacaatgacagttatctaagaaatcttgctaatataatctcatagtgatactgtaagctgagtatcattctccccattttatagtttatggttaaataaaaatttctaaagatttccctttgtgtccaaggctacatatattttggaattcattctttaatgctaagaacttaaaatacactactctctatgaacactccctggtagtactagtaattctttctatattcttgtatttgtgagtcattaaatctgtacaaaacataatttacaactaaaaaccaaaaatgtctagacacaaaatatttggtcaatacaactctaaaatacatacattcactattattttataaagaaattggatggcctagcatatgatctatatggagttaaggaaccaaatgggtgattctaagatacaaagaatgaaagataaattaattatgtttttaatcttctatcagtgtaatacattgccttaattgtaaagcagcagaatgaatcaatgtaggtgcattcaatttttcttttggaaatggaaattacattttatcattgtcatcctaagagtaatacaagattttgagaaaagttttggtaaaaacagaaaaatgttagaaaaaatttaaaaagtaaaaaaaaaaaaaacttcctcatagcagaaacaagggtaaagaagggagggaaaaggggagaaaggaaaaaaacttgatattgttcccggagagaacaaagtatggctgcctgctcttgaggtccgaaaacgagatgcagacaattgggaaagaagggaggtcagagtaactcaccagaccaactcaaagttctaagcttttttctagtgcttgtatatatttaaagctccgtgctacgtgtgggattgtaactgcaagtgggagtgttgcattcaatctctatctcatctttagctagggactagggtctggaaagctttctcgagagtcttggaaagtttcttaatcttaagacagaatgaggtgtatgtgtaagaatgcttttattattccatcagatttcaggggctgagaaaacccaggcaggttcttaatgggttggtttttgcattccagttttgtactcaggcaccagtttctccagttttttaatgtttagcttacactttcattaacgttatagtaacgggttcttggaaactgatcgttctgtttgctaatggaaacctggcctgtcacaatatcacactattcaaggaaattcctagataatcatacagattatgctacatttggtaacatcaagatcaatatagaaagcagagagttggggaaaaaattaaaatgcaccctatatattatacagtatattaaataaacgttctggaatgcgctctttctaagattggtcagcatttaaaacatggttgaggaaaaagaattctactccttaatcacctgtttcaactattcaggaaaaatactgacacactgactgcctaaggcagaagatcctacaagttttgttatgtaaactctttttaaaagttttaaaaccaccctttactattgaatgtcatttgcacttgttttccccttgttttgtattacaagtctcagtaaaattctcatttaaccatgtagcttttgcgttaatgatcccagcactaaaagtcgattttcttggcctggttttctaaccatatgctgtggaaagaatgctgtgtaaatatatttcctcttctccacttcataatagaccctatggtcaaaggggactaaactaaacctgaacaacattacatggatgatgatttaaatttttaatatataatgcttaaaactatgatataaaaactatagccagaacaatcatggttggctactaattgatatatagttttatggcagactaggtttccattagcaaccagatgaatcaatttccactaacccttttctataattttgatgaatgtgtaagttaaacattaaagagctagagaaactggtgcctgagtacaagaactggaatgcgaaaacaaacccattaagaccctgcctgagttttcccagatcctaaagtctgatcaaataatgaaagcattcttacacatactctttgtaccagggcccacttaagattaaaaaactttccaagactttagagaaagctttacagaccccagacggtagttagattgtacagactgaatgaaacactctcacttgtagatgcactctcccatgtagcatggagcttagaatgcatataagtgctaaagaaaacaaaacaaaacaaaacaaaacaaaacaaaaaaccaaattgtaactttcagttggtctggtgagttgctacaaccttttccctgtaactggttgcaaaaataagctcctttctttcccagtctgtctgcatcttgttattgggctgcaagaacaagcagatggaccctattctatctgggaacagtttagtgtgtatgtgtttttaattataaaataattattttcccatattcttaaaaattcttcaaaaacataacttttgtgaacccaaaagtatctgagacaggttctgagatttattttcctttcacatttttatcttatgagaagaccatcatgtttttagggatatgtaggtgtttccaactattttctattataaataatgctataacaatattctttgtacttaaaatctatatgtgcatctctaatttttgacttaacttactttggctaagtcaaagaatataagctttaaaagttttgtatccatcatgccaaaatactctccaaaagagctgtatccctccttcccccagtgcaggagactgttttccagaaccactgcactgcatacagtgaatggtgcccctgcaatgatggaactgttgttttcctgtgtttataacactggaaatcgtaagtaaaataacaacgccaaaaaatgtttgccaacacaactggtcaagtaaatatccttcctataaataatttccatttctctgattattagtactattaattattttcacatattttaaggttagttttacatatccttttaggtgactttactgttgcacgtgttttggccatttttagtcagaacatttgaattatttactaaattgtaaagagcttttttatttaatgtgaatattaacacttgttacatgttaacaactttttatttcctagattcttaacttttctaactttctattatacaaaatttcaaacacaaacagcagtagaaagaatagtataatgagcccaatgaacacattccccagttttaataataatcaattaatcccaatacctttttgatccactaaagttttatattttttcaaatttattactttttctcataatttcttcttttgcctttaagtttagaaggaactccctcactctcaaatatagtcatttaccatcttagtatattttatagtttcatttttacattttttaaaattttacctgaaatttttttggtgtatagtgagaggtgaggacttaacattctttttgtaaacagccagccatctagcatcatttattaagtaatttttcctttccctactggggatatttcaaaccagtatactctttcttaaatacagaagagcggctctgcattttagctttgttaaattcatttgtcaatttttttttttgagatggagttttgctcttgtcacccaggctggagtgcaatggcggctcactgcaacgtctgcctcctgggttcaggcgattcttctgcctcagccacccaagtagctgggattacaggtgttagccaccgcacctggctaatttttgtatctttagtagagacggagtttcaccatgttggtgaggctggtctcaaactcctgacctcacgcaatccgcctgcctcagcctcccaaagtgctgggattacaggcatgagccactgtgcctggcccatttgtctatatatgagtaccacacatttaattattttgctaaataatagattttaatagctaaattttttagaaatgataaaattagaatcagtcttccttcacaacttacctggttgcactttttaaccacatctggcccaggtgtggcattgagaagtgctataataaggtaacgatttagcagcttccctagtcctagttcttgcaaggtgtcatctgtaaggagtccattccaaagaagaatattgcggaagagctaaaataaaatatcaagtaaatatgtaccttttctccaaagagaaactgtaatagtctctaacaaacatgaagagttggtcaaactaaaattctcactacaattagccctgttggaactgtcaattttagaatacaatatctctgaataaatacttgattctttccaaactccatgtatttgctcatcttattttcattttctaggataaccatccccaaatctatctcaaataacttcactagagcctttccagatcaataatcttccttcccaatccattttctctcaaagccgggggccatcaagtataagaccacaggaccacgtgattcataaagaactactgtcaaaactagggccgccattaccaacatgtgaccttgagaaggcaatcaacgctgagagcttcattcctctgatacataaagatttataatcacctttgagtttgaagataacttggattaagtaaccataataaattctaataaaatattggttgtcctttccctctactaaattcagatctttctgtgaattttaaggtgtttctttttttgcagtactatattcattactctgagtgctgaactacatgctgttttactaaaatgtaatgctttttcacattttatctcattgttgatgttgttccctcttcccagaaagccttttccctgattcaaccacatgacaaatattaattcacactattaaaactactcttggtgaggtcacctatatccttctaattgtcaaatccaataaacagtgtttcagtctttctcttaatactctttggtggcatttaacactcttttcttcattcttgaaaatctttcatttagcttccttgaggccattctcttgtgatcatcctaaggctcataattgattctacagattccctgaagcctccatgttctcctcttctgttagtatttcccgaggttctgtccttggcctacttctcatgcttcatccagtctccttacgcagcttgccattcatgaccatggctccaaatattacctacaggtagtggactcccaaatctctagctcagatctgtctcctgaaattcagacttatgtatccaaccacctcctagacctctgtatctctatttgtcccacatatatcttcattatgtacaaaatagatcttatcttcccttgatcagttatcgactcctttcaatgcttcctcccaaacattgtttgaaccttcttctccttctcatccctactgccactgacttagcaataattttaaggccaggggttagccaactatatagcttgtgggttaaatccatcctgttgcctgtttttatagggtccgtgagctaagaatggttttaacacttttcaaggacgttttaaaactgtctttaaacaaaatattttgtaccatgaggaaattatatgacattcaaatttcagtgttcataagttttattcaaacagccatgttcatttgtttatgtactatgactgtttttgtgctacagcggcagagttgagtaattcgacagagaccatgtgaccacaaagcctaaaatactatctaattcttatagaagaagtttgttgttctttgttctatagtaaacaggatttttacaaaaattgccttttcatttttgcagtttttgctcacctttaggcctgaccagaactgtctttcttggaactttgaatgaggtgatgttttgttttctacagcactaattagaaacaaacgaaagagaagagaaaatgcaaagaactattagtctttcagaaccagagtttaagatcagactttcttttaaaccaaccaaactaagccttaatggaatataaatagagattgtttattttattttataaataaaatatatatttatttataaaatatatatttatatatttataaatatgtttataaaatatatatttatatatttataaatatgtttataaaatatatatttatatatttataaatatgtttataaaatatatatttatatatttataaatatgtttataaaatatatatttatatatttataaatatgtttataaaatatatatttataaacaaataactaatatatcacattcatacatctgaaccatgtgaatgcattatctaaaacattataaacaaagtttaccaaggcagaatttttacatgtagacatctcatgattcaaaatgaatcagaaagctttgaggttcctttcttccccctccataaagctcctccatcctgtcactactcactggattgctacagttcatgcatcattataactgatggcttcttagcaaagttatgatcatacatcaaatactcgttttataatttaaagtgactgcagaatttacaggtgcagtttctcgttcctcagcattgtgcttcctctgtgctaggccctgttgtgttctgagcattctcttcatctccctaatatcctgtgaggtaggcactaattttatccttattttatagatgagaaaacaagtgcataaaaatacctactaacagtggacgtgtgctctttaccactctatatcacctgctatgttcctaggatatatgtaaaaccaaaaccaaaaccaaccaaacaaaattcatctaagcgccaagataaagcacggctttatgtaagtcactgagaaatatttgttgaaatctcaatttgcatcctcatagagtatgtgtacacatgttttgaaaacactatagttggccgggcgcggtggctcacgcctgtaatcccagcactttgggaggccaaggcgggcggatcacaaggtcaggagatcgagaccatcctggctaacatggtgaaaccccatctctactaaatatacaaaaaattagccgggcgtggtggcgggcgcctgtagtcccagccatgggaggctgaggcaggagaatggcgtgaacctgggaggcggagcttgcagtgagccgagatcgcgccactgcactccagcctgggcgacagagtgagactcagtctcaaaagaaaaaaaaaaaagaaacacaaaaaacaaaacaaaaaataaaacactgtagtttcttttgcattgcattcttaaacaaatctgtattctatgatcagctatttccaacaatctagaaattaacagcgcttacctctttggatacagaggaataaaaacatcatcttctactgcctttttcattcttgaaacaatggatttaagtaaatcctattattacaaatttgaaaagcatcagtgatagaagatagaaatgtatttaccaaaaaaaaagtaattttaactgcagtacaaatttatccacactcacataaccagctgttaaaataactatcaattgggtacaaaaaaaaccttatttatccatgttgctacatatgggtatagttggatcaatttcattgctatatagtattttgttgcatgaatactattgatggaacacttaggtgatttctggtttggtggctattataaataatgctgccataaaaattcttgtacatgtcatttagtatgcatggtcatacatttctaatgggtatataaatagaaatggaatggctggagtacagttcatgtccatacgttcaactacgtacaaaaaaccaaacggtttctagaatagtggcatcccatttacatcattcctgcagtataaaataaatcctgtttcactacatacttacgataattggcattttcttgttttttaatgtttgcaattatagtgggtatgcagtcatatttcattttgttgttttaattctcatttaattatcattgagtaatgtgctgttgggcatcttttcatattcctatttgccacttggcaagccgttttgcaaagtacctaattaagctgcttgccaacattgctatttttttgtattaggttctgtctttttattactgatttgtacaagtcttttatatactccagctgtgggtcctttgttggaaaatccacttagggaaatccattttgtttgtacataaaaaaattggaaatgaccaaactattcaatcacagggaattttaaggagatgttacatcgctccagtgaatctatcataaactttagctgaagattatgatgactacagtaacagacaactataaatacgcaatgagataacattaagcagaagtagtatactaacttacatgcctattaggattataactttgaaaaaaaagccaggatgaaaatatcctacgatggtattaatccttgtactaggatgaaagacaatgagtgtttatttttttcatatattagcaatatttatattatttatataatgatattcttattcatatttgaaaaataaaaatggcatactacacattagagtaaaagttaatttttaagtcaatgacaatgtatacagcacaaattcaactgtcacatactatatactaactgaattatccataaatgtagaattcaaatatatttttctt

SEQ ID NO: 8824 - DNA, 4864 bp, Homo sapiens
cttttaaatcatttaggaaataaaaagtggagttagaaaacagtatgatagtaatactgacttttatatttgtcaatatatttatcttattttggatccttatttcattatatagatttgagttactgtctagtgcccttccatttcggcccaaaggattcccttatgcatttcttgcagggcaagtctaattgtaataaactccctcagcttttgttttatctgagaatgtcttgatttctcccttatttttgatggataattttgccagatacatgaatttttggtaacagtatttttctttcagcactttaaatatgtcatcccactaccttctgacttcatggtttctcatgagatattagatgttataaaatttgaggattcctcattcttgatgagtcagttctgtcttattgcttttcggatttgctcagcttttgtcttttgacagtttgattataacgcggctcagtgtgggtctctgagtttatcccacttagagtttgttgagtttcttggagtcatagatttatgtcttttatcaaattttggacatatttggctattatttcttcaatttttttcactgcttctttcttttccttctgaaatattcttaatgtatatgttggtctgtttgatgctgtctcaccagtttcttaggctgtgttctcttttgttcctcagacttgattattgcagttgcccttctttttatttttttcaagtttgttgattcttctccctgttcagatcaactgttgaactcctctagtgaatttatttcagttactgtacttttcagctccaagatttatctttggttcctttttataacgtctgtgtctttattgatattctcattttgttcatatgtctctttcttcctttagttctttgtccatgttttcctttagctctttgggcttatttaagacaattgtttaaagtctttgcatagtaagtccaatgtctgtgtttcttcagggatggttttcattattttgttttcaatgagccatactttcctgtgtctttgtatgctgtctttttgttgttgaaaactgtatgtttgaacatcataacgtggtggccctgaaaatcagatattccccccttcctgagagttagttttatttttattattgaagattgtagcagtctattgctacatgtgcagtcatttccaaactatttttgcaaagactgtattccttctgtgtgtcatcactgaagtctctgttccttagtttgtgtttaatagtttgacatagatttccttgaaaggagttaaaactagcagaaaaatctctctcccagtctttccagtctttgtagattggttctgtgctgggcttttccattaatacttagccaggcttgtactgagcctaacaatcaggcccaaaagcgtagggtctttgcagatcttgtctgagcatgcttcttgctgtgtatgcacgtagttttctaaatctccctgtatgtgctgttgaatattctaatttcccaaagaaactcctttgcagctttttctcacagaacatagatggttttttggatatcttgaccatagtctttcgacccaggtgtttgcggttgttagttcaccttacacttttttcaagcattgcctactgcttacgatgagtgctctgtcaatcctttaagtagccccagacaggctaccagagacttaaacaagaatttgtaagttctgctcagcttcctctagaaatggggatcagggtccaagacagaatgcagttgctgatttcaagactgctgcaacaccagggagcttgtgggggaagggcaagcagaaatgtcacaaagctttcttgccattttaaagttgcctgttcttgactcagcatttgcttcattgctataaactttttactgtttttcagagttctgataaaattggctatgcctgttcctgctttaaaaaatatatatatattttttagggattggggtctcactatactgaccaggctggtcttgaacttctggcctcaagccatcctctcatttcagcttcccaaagtgctgcaattacacgcgtgaaccaccacacccagcccctgcttgtttttcaatgtgcctactccaccatgttgctcaagtatgtatattttctaaactaccttgtagtgttgtgatgggaaataaatccctgagccttttgaataactcagagagatcaaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttgggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatgttaggtatagatttttctcacagatgccttttatcagattgaggaatttatattcctactttgccgaaaggtttttgtagtatgagggggtgctgaattttgtcaaacactttttcggtaataattgagatgattggttctgcagtcatcgagatgtggattttctcctttattctgttcgtgagtgattacactggttgactaatgttaaaacaaccttactttccaggaataaaccctattatcttttttatacattgctggatttgatttgctaattattttaaggacttttatttctacattcatgatagatactgctggtattttctcatgatgtcttttgcaggatttgtatcatatatggcatttctgaggtatacctaagtatcatttattcaaggacctaagaaatggaaaaatcaattgaggtgatttttccatcatgaaaaaaatttctttaaagtcatctgtctgattctgtaaaaatttcacattctttatgtgaacaaaaagctgaaagaaattcagggaaagaattaagatgtgatatcaattgccaacccaatgttttgttcttgctagttgtgttccccctccttattccatccatttcatagtaataagaaaaaaaagaattttacattgagatttaggtaaatttttgaattacagtatatgataaaaaccttaacgttcaaactccaggtataatgaaatttaattgaaaattactatagcagtttaagtcaatttgtagttttgaaagcagttttaatattttatcttccacaaaaaggtaggaaagtttctgtgctgaacttaaatatataaaggaacacgtccaacatatttagttaaaaatccaaaagtcagaggataatttccaaatgtgtacttaaatagaaaaaaattacaaatttcatgtgcaataaagtgtctgccacttacgtaaaaaaaaaaaaaaaacccaaaactatgtacacatagaaacacgtaacatttttgtaaatagagaaaaggtctaaaaggataacattaaaatgaaaacagcagttatctctggggacagcggttgtgtggaaatgctaactgcttttcaacaatagtttgcattttctagatgagattctatccttgtataattttgttactaatataaacatcaaaaaattcttcataccagtgaatcacaagtcctcactgcaacagacataacaaatccaactcctaaaataaattatatgtagttttgaaggtagaggtgacataaaagtaggctgtatattcaaatcctacaatatattcaattttttccaattatcttttgaacaacaatttgcaaaatatatttacagtttcccttaagttatttaataagtagacttagaaaaattactagtaaactaacatttttggaaaattttcttaatttcttttgattaaattatcttgcctctgttttattagacaaatattttatcagaaaatgaatcacatgttgtgagtatttaaaatatctgtttccttcttagtcctaccaccaatgacaaaaaaacaaaatagtaacttgctaataagtaatgacttaatgcttcaaaaaacatcaacaaatttaaaagaaaggccaaacatggttgctcaagcctgtaatcccagcactttgggaggtcaaggtgggtagactgcttgagctcaagagttcgagaccagcctgggcaatgtcacgaaaccccatctctacaaaaaattacaaaaatcagctgggcatggtggcgcatgcctatagtcccagctacttgggaggttgaagtgggaggattgcttgagcccagaaggcagaggttgcagtgagccgagattgtgccactactctccagcctgggtgacagagccagaccctgtctcaaaaaatacaattaaaaaaaaaataaaagaaaaatggcaaataaggaaaacttctgccacaagcatgggcaaaaaatcaatatctttaaaaatataaaggtcttaaagtccataagaaaaagatggatatttcagaaataattacaaatggccaaaaccaatatgtttactctctaatagccaacacaaaatacgctattaaaataagatttttacctttcaaattttcaatgcatttttaaaaaggataataactactgctggtagggattcattggcactcacttatgcttatgttggtacattaaattggtacagatttctgaaggataatttgacaatcggcacatgccttaatcatttaatacttagca

SEQ ID NO: 8825 - DNA, 752 bp, Homo sapiens
ctgagttaggtgttcatgatacaaaaaaagctgctttgatttttttcatttaattttaatgattttggatgctggccttgacaaatgttcccatattgtttaaattttgtttcttaaaatagttctattgaaaatgttataaaggacattattgaatcaactggcaaaagtggaatatggatggtagattaagtgttgataaatttactgaaattgctaactactctggttatataacataatatccttgtcttaacaaatatgcaccctgttctcagtactcaggagaaaacatattgtatgtatatatttaaaatggaagggctaatgataaagccaatggggcaaaatattaatgacaagtaaatcttggtaaagggaatatggaaatactactcttattcatgaaagttttctttcaaagtattaatatttccaaataaattgtttaaaacaaaacataaattcactggccggttgccgtggctcatgcctgtaatcctagcactttgggaggctgaggtgggtgggtcacttgaggccaggagtttgagaccagcctggccaacatggtgaaaccctgtctctactaaaaatagaaaaaattagccacacatggtggcacatgcttgtaatcccagctgcttggcaggctgaggcacaagaatcgcttgaacacaggaggtggaggttgcagtgagctgagattgcaccactgcactccagcctgggtgacagagtaaggttctgtc

SEQ ID NO: 8826 - DNA, 102 bp, Homo sapiens; identical to SEQ ID NO: 6331

SEQ ID NO: 8827 - DNA, 105 bp, Homo sapiens; identical to SEQ ID NO: 7608

SEQ ID NO: 8828 - DNA, 160 bp, Homo sapiens; identical to SEQ ID NO: 7770

SEQ ID NO: 8829 - DNA, 15962 bp, Homo sapiens
ccagtgtctgctcttttcgatccgggacggccggtcaggctcgccgccgagctggtaggggctgggggcgaggggtgcgggaaggtgaccggggcactggcgggcggcgccgcgcgcggccgggggccagggtccgagcagcggggtgggggcggggcggtggccgggagcgcggggggtgcgggtcaccaggccgggccggcggcctggaacgtgcggcgccggggagaccgttccgccgtgctccggccgtgcgcgccggcgcgaggggcgtccgggccggccgcgggggcggggaggggaggggccctctctctccccctccccccaccgcattcctctgacgttgggacggagcgaccccgcccttcgtcgcgaccggcccggcctcctcccgtcacgcgggccacgtgcttcagacgcggccccgcccccgtctctgttccgttggcgtggtcggatcttcctggtgtccgggggagctgaccgaggtccccagcaaggccccctcccctaactttatttcccctcaccggcagagccaccaggcctgtcccctcttgtattgccataaaccccattttttctgatagggtctcgctccgtcgcccacgctggagtgcaggggcgcgatcacggctcactgcaacctcgaaatccggggctcaagcgagccttccgccttggcctccccaagtgctgggattacaggtgtgagccaccacacacggcctccatttcaaacttagtttccacccggacctcaactcgaaatcccccatcagccgggcagaaaggtcctggagcacttttggggcgtccgccgcgtttctcacgacgctagcttcgcttttatttcttttcccccctttggcgatatcgtcacttgccaatagcttcgctaaggtgttcccccccacaccctgcgcgggcagccccataatgttaaatgccgtaggacgggatcccgggttaatccccgtttgaccccgctgcctgcgcgtgataactggggcgcgctcctctccaccccccaggctccgccagttgggcttcgccggagtctggagataccctccgacattctcttggtgcagtgcgggtggtcttaccccgcccttgaggaagaaaggcccgacgcaggcacagatcacaagaacgcctcccctgtgcagggggcttgcactgtgccaggtgctgtactgggcgcttggtaggtggccaccctctccagggtcggggccaggacctcctgtggtgctcagaggggtcgagctgtcaggtgaaaaccactggcccgagttatggctttgaagggaatcctgggggtctgggatggcagggacctgttaatttagatcgcacggacaagatgacttggcccttagctcctgcaggaggggtagtggactattgcaggtggaagggactgcatgggcacacatggagagtgcgcggaagagccttctcccaagggaaactgaaaggggttgcggctgaatttagaactggacagggtccgaagacagtcggcagcagcgagtggttttctactgaggaaaaggctcagatttgggattttaacaattcctcctagaggtagaaatgaacacggtatagtgatggcgacagagataccctgggagttcctgtcaatcttggtctagccttccggcgcacacacagcggtcgctccataagggggccccgcctctgggcggtgcctgaaagcgtatttgcgcatgcgttctcgccttcgctcgtttcgtatactgcaccaaagagcgcctaccctggggcggggctccccatttcatccaatcagagcgtatcaacagtcctaccatctggtgagagggtgcgctccactctccattgaccaatcagtggagacgcagaagaatgggcatctgtaaccaccactggagagagaccaaaaaagggcggggcttccttgtctccttgcgaagtggcgcgggaaggtcgtcattgtgactggtgctgacggattagcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggtgaggccagggccctaggcgctgggaaggccgggaactgggggacaatttcccagcttgagggcattttattttttgaggggggcctctgcgcacgcgcccaggccatcgcgtcgttgacggtgtgggggaggggcggccgttgggcaaacggcggggtttgcgcgaggacaggcgcctgcgcgtgcgcggggtccggagcggggtgtgggggagcgcagaggaagtagctcgtgaggcgaatggcccagtgcgcaggcgccgcgggctggcgtgtgggggccgggcacgcggcccggccggtttttttcccctttatcattttcttcgctggctccatgcgcaggcgcagtgttcccgcccggcctcgtgggcggttaggggagcgcctggtgagcgggaacgggtgggcggcggccttgttctctagagtggggaattccgtctgatggcagcttaatctctaaggcccagccttgtgtctatacagaaatggatgtgtttgagcctagatgctctcatttttgtaggcattgaaaatgggaagaggacttgtgaaatgcacttttagccttttaggagttgagcgaagccttgaaaccatcacaagtttgcttacagtttccggggattcactgggtaccgaggatttgataaaccaaactatttcctggccatgttggaagcatttcgaccccctgtaatcagtccctccgaaaacaccagtcgttgcttttggagtggggcccagtccccactctttccaaaatcttgaagtcttacagggccgcctatttgcagggttttccagggtttaggggttacgagttgctagcgttttaatcttggccttgtcccacacattttaaagacatcttaattgaaaatccttaacgcttcctgaggttgggggagatactgggattcccgatttacaaaggaggaaatgggccaggagagagatgagatgaggtgaattactgtaggtggcacagctagtgaggggcagggctggagttagaactcccatttgtgggagctgctaacctggcgggagtgcctcaccctgtggttcgcgtggatcgctcctgaaatagaatccaattctacccaccttccacgcacttctgcccagtgattctcagacagggggccggccccagagcccaggagaggcggaagagagttaatctttctcctgatgaccagaggcttttgtcggtgggtgtaagatacttctcttaggaaggagcagtcggttcttaatggtatgggttggagtctctggtctttctaaaagactttccatccgggagtgggggctcatgcctataatcccagcactttgggaggctgaggcaggcagattacctgaggtcaggagttcgagaacagcctggtcaacatggcaaaactccgtctctactaaaaatacaaaaaaattagccaggtgtggtggcgagggcctgtaattccagctactcgggaggctgaggcaggagaatcgcttgaacctgggaggcggaggttgcagtggactaagatcacgccatagcactccagcctgggtgacagagtgagactccatctcaaaaaataaataaaagacttttcttgtctggtttttcttagtctgacctaggcagtaatttccaaagcagattttggtgggagggcgattcaagactagaaggggtcaagactggcctggctgccccagtttctggggcatgtgttgttttttgccctgactgaacctgggtgtgagtggtggggaacaggtgtgcttagctagatgatggtggctcagccagttaaagggcaaggaatttggggcacatgcaaaggggatgtcctcattcaaactgtagcagatagctgttagagcccttgctgccagtgtatctccttttccagctactcttttcccatgtttccttggtcgagtggaccagtgggaagagaggggggtccctggaagaacgtaagatttgggacttgtgtggccctccctccgttataccttcctcagaagctacagcaagagccagtgggcaagtgatcacccactcaggaccactgttctgctgacccagaatccttctgggctgattggcttcaattgctgcccctagtctttcctgtgcatccttcacggatgacctccaactgttttatctgactgggtctacaacagtacagaggccagtggggcgtcatcttgtacagcaagaaaataattcttgtttttgcttcctttctcaggagaactacgatgacccgcacaaaacccctgcctccccagttgtccacatcaggggcctgattgacggtgtggtggaagcagaccttgtggaggccttgcaggagtttggacccatcaggtactgggctcagaggccaggtgttgggcttccaaagttgactcctgggtgtccttgtgtgtccacgatttctggttggaaatagtgattttgttgccatcctggtctagattctgtggccgctctgcttttgggttggccattgtactttgtgtcagattacagcaagttccatgaccctttttccttccttcgtttttcctctgccttgtagtttctagtcagtgttctctttttcagacagagcaaggtctcgctttgtggcccaggctggagtgtagtggtgcagtctcacccaggctcaggcagtccttctgcctcggcctgctgagtagctgggactataggcatgcgccaccatgcccggctaatttttacatatatatattttttgtttgtttgtttgttttgagacagtctcttgctctgtcgcccaggctggagtgcagtgacaatctcagctcactgcaagctttgtctcgtgggttcacgccattctcctgcctcagcctcccgagtagctgggaccacaggcgctggccaccccacccggctaattttttgtatttttagtagagatggggtttcgctgtgttagccaggatggtctcaatctcctgacctcgtgatctgcccgcctcggcctcccaaagtgctaggattacaggcgtgagccactgcgcccggcctaatttttatattgttctgtagaggtgaggttttgccatgttggccaggctggtctcaaactcctaggcccaagcagtctgcccacctagccctcccaagttttagggttacaggcatgagctactactgctcctggccagtgttctttcattcagcaagtagttactgaatatttggtgcatgctatatactgcaaatacagtagtgagctgtatctggatgcttctcttagaaagttgccctcctagagtgatttgcactgtcatagtgtaagctcaagaagccgtctgtgggtggcatctgacagtctggtgaggagaggtcaggaaggcttcccagagggacatgatggctcagctagacctctttggcttttggtactacttgtggcacagggtgttcaggtcggggaaccatgatagggttgcagaggagttcagaggccatggaggagtcagttctcaaaaaatcaaatgataccctcctcctgtctacattttcctgagaggattgaaacctgtgttctctctgccagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcaggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatcttaggggagagagcagtgtgttgggagatacaaaggaatttatttttctttttgttttctttctgttatttacttatttatttattgagatggagtttagcccttgttgcctgggctggagtgcagtggtgcgatctcagctcactgcaacctctgcctcctgggttcaagcaattctcctgcctcagccttcctagtaggattataggcgcctgctaattttttttatttttagtagagatctggtttcgaactcctgacctcaggcaatccacttgcctcagcctcccagattacaggtgtgagccaccgcgcctggctaggaatttatttttaaagatgtttattctaagttcaaatatgagtgacaaagatttggggaacatagtctcaagaggtcctgagaaaatgtgcccctgggaaaaggaatttatttaaaaggggatatggggccgggcacagtggctcatgcctgcaatcccagcactttcggaggccgaggtggacagatacctgaggtcaggagttcgagaccagcctagccaacgtggtgaaaccctgtcgctaataatacaaaaaatagccaggcatggtggtgaacgcctgtaatcccagctactctggaggctgaggcaggagaatcgcttgagcctgggaggcggagattgcagtgagccgagactgtgccactgtattccatcctgggcaacacagcgagactccatatccaaaaaaaaaaaaaaaaggtggggcatgtgtgaaggttgctgaggaggtgatgtcctatgagcaaataggagcttatactcaaggtggaggaaacagcctctgcaaaggttgtaaagtcagaaggagcttgtgttggatggagaaattgaaagacctgaggattgcaaagtggctggcaagcagacgggtttggaatagacattggaagaagcttttagggcatcctagacagcgttgcgatgcttggggcaggggcaggaaaaagccactgatggactttcagggcagagctgtaatcgagttgatgtttcagatttagtcgaagggtgtgagagggctgagacggagaaagtggtgtggcagaagaggttgctggtggccatgggtcggggtgcagattatgagagaactctggccagtgactgctcacccggggcagcgttgagtccatcaacaccgttttggtctcttaacctgaggctagtggctgggcagtgagctaatcccaaagcttccgtctgtaccacagtcttggggtgctaccttgtccttatcacactctggggtaacttgaagcccttctcaaagatctcctgtgatgggactttccttaacttgactcacatttgactcagttcaaagtgcccagcgggccaaggcctctctcaatggggctgatatctattctggctgttgcactctgaagatcgaatacgcaaaggtacatctgggaggtgactgactgccccttgtcagcttccaggtgagctggggcatggctgacctcaagtcttgtcttgtcctgtccttgcagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagccccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagaaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgtacatgattgcttatttgaactgattctgctgttgccctgcttgtcagctacagtcagtccctcttgggctggcgggactgggagggaggggggactgggattaagaaagaagggatctaacagagacagtctggagctcctagaactttgggggctttgggggtcaaacttgcttgcttccctctggggttattttcctcttaatctactctcccttcattgggagtcactttagaaagctgcttttggcccgccataatatatcagcttctgtagcagctgcacattccccagagggcctgggagctgggctttctcccagggccagggtaggtgagagcacagaatctggccttgtccttcacagaacaaggccagccctttggtatgagcaggggaaggagagtgggcaccagctttgaggctcgggcttcatgcccgccgtaggtcagatcacaaaaggaggccccacagccctcgaggaagggagggcttgcagttggcaggagctgggggctcagatcagcctgtgcagtcaggagggagggagagaccccaatttctgagtgagactcctaactgttttctctctccacaggtgaccctggcagcaaccccaacaaacgccagaggcagccccctctcctgggagatcaccccgcagaatatggtgagggcagggggttcccctccgtggactcccgtggctcatgtgcccctgcccgccgcccgccgtgcaaattctcacccgtcctccctctctttccttcccaccccccaggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgagctgctgccgggccccctgggttcctcgctgagcctcgtatcttgccagtcagcacgggaaagaaccaggggggagcctggtgtggcgctgggcgggcagacgccaatgagtgactcagtgagctcaggcagcctgcttgcagacgggttttgtttggtcctcactgtatgtgggtgttgtgtttttgaattaccaatgtttaaaaaaaagattttatcacataaaagtactaataccagtacatgaacatagagatttataaaacataaaaatgaatccattatagtgaaacaccatcgtttaaggatttcctcctgaaaacttaagacctggcaacaccgggccttctgccttcccatgggacagttgactggggctagcggtggctgagtgtctacctgagaccaggcggcattttgcttaacattaaacccgtctgggtcttgggggcctttgtgcagctcatgacttggcccattacttagagtagttcgtaacacaggtgaagtgttgttagttaccaggcactgttaaagatgctttacatgtagtgacctgtgtaatttctcacattaatccttaatgagatggacaggggaagtggaggacggggcttaaataacgcgcccaggttcacatagcctttatgtgaagcaggactcagagccagactgcctggctccagagccggcactgctctgttgtaacccagctgaaggagtattttaccttgtgactgtagacacagccatccatagatcacacacgtctgtgtgtaacagacaaaatggtgaaaatggctgatttgatttctgattcctgtacagttttctgtcatgcttcactaaatgatttactggtgggttatgtcccacagttaaaaacatggcccaggctctgcttctcactatgggttgagcacttggtgtgggccaggcatgtttttctagtggtcccgattaactgtgaggacatgggaggccagagcaggggttattatcactaacttgggaggggcaggagaggggaccctggcagctggacagaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctggtaggtgctcaggctcgggagggcagcagaggtacaggggagagaaaaggaggggaatggggcccagcagaggagcacagtgaggccgaggtgttgactcacacagaaatgggatgtggcaggtgtgttcccagacgtgtctctgacaccacaggagaaagtgagtcagccttgcctcaggtgtagagcaatgccccaaggcacacagggcaagctaagcctctggaggccacaggggaaagcttcagggacaactttgggtatgacaaaggctcccctttcttccttgctgcagtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgaggtgtgtgccgtggagctgcgcaggcagtcgggtccttgccacggccgtctgagtaggccattcatttcagtcttttctgcaaatagctgttgaactcctgtcctgcctggccctgggttgagtgctagggacacagcagaggccaggacagataggaatctgtgctctcaaactggacagggtgagaatggcaccaagtttctagcaacaccatttgccgcgttccttccttttacatttttggcaagcagggcaactgctcgtttgctgggaaagctgcttcacaggcccagtgatgagggcccaatttcacaagaaccgcattggcgtaggcttcgggtgccatcaccctgataccatcagaaggtggggccctgtaaagctcagtcagggggaactgaggcagcggaagggaggaggaactcaagtggatctggctgtggtctgaaatgttgaccttgcattcagcaaacagtgttcagcaaacagccgggtgcagatatccacatagctgttgaagttgggaacgaaaaagcagcttcccagtctcaggcaacttaataattaaagagcattgttgctggcctttttatgacacagggatgccttagggtatgtgataaaatctacaagccttttctcctgaaaacttcaagtactgagtcatgcagggcctggtctgcttgaatcctgtgtggcggcccttttgtttcagagttcatttactacctgttttcttttgcagatctgcgatgagctgggagtgaagcggccatcttctgtgaaagtattctcaggcaaaagtgagtcgagtgtgcccacctccttgccctaattgcatggtggttggtgggcagctgcctagttcctattgggtgagtctaaaacctttacttttccccttggtttgcaatcaggtgagcgcagctcctctggactgctggagtgggaatccaagagcgatgccctggagactctgggcttcctgaaccattaccagatgaaaaacccaagtgagtatctgtgtgtcctgcaggcatcaacctggtgacctaatgggttggctggcttcaggccagggatgtccttcctgcccttgagataggaccccgggatcttcgcactgttggtgacacaggcaggtgggacctgctcatcaggagagcagcctgtgctcctcttgggagagccagcctgactgcctgctgccactcactctgccagcttgggagttgctcaggcttgtcctccagggaggtggcattctcttctttgcatcagagactggcttaggtaggaaagccactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagca

SEQ ID NO: 8830 - DNA, 180 bp, Homo sapiens
tgtcacccaggctggagtgcaatggcataatcttggctcactgcaacctctgcctcctggttcaagcaattctcctgcctcagcctcccaagtagctgggattacaggcatgtgccaccatgcctggctgatttttgtatttttagtagagatggggtttcaccatattggctaggctgg

SEQ ID NO: 8831 - DNA, 261 bp, Homo sapiens
tttttacttttatttatttatttttgagacggagtctcgctctgtcgcccaggctggagtacagtggagcgatctcggctcactgcaagctccgcctcctgggttcacgtcattctcctgcctcagcctccccagtagctgggactacaggcgcctgccaccatgcccagctaattttttttttaattttttttttatttttagcagagacggggtttcaccgtgttagccaggatggtcttgatctcctgacctcgtgat

SEQ ID NO: 8832 - DNA, 776 bp, Homo sapiens; identical to SEQ ID NO: 7382
  misc_feature (709)..(709): n equals a,t,g, or c
  misc_feature (738)..(738): n equals a,t,g, or c

SEQ ID NO: 8833 - DNA, 878 bp, Homo sapiens; identical to SEQ ID NO: 7383
  misc_feature (741)..(741): n equals a,t,g, or c

SEQ ID NO: 8834 - DNA, 150 bp, Homo sapiens; identical to SEQ ID NO: 7384

SEQ ID NO: 8835 - DNA, 845 bp, Homo sapiens; identical to SEQ ID NO: 7385

SEQ ID NO: 8836 - DNA, 10714 bp, Homo sapiens
ggccacaacgccactggattggtggtagggcggggcgggccacagtctccagcctgaagcggaagtggaggaaagatggaggtgtggggacaggagctgggtgtgctggggactggccgcggacccctaacctgtgtctccggtctccctccgggagcggctcaacccagcccatcgctctggccccgttctggccctgcagggtggtggttgggacgttgaaatgagcgcgcgagtggtacgtcctctctccgcgctcacgcccccctcctcaccgtgtttcccgccaggaccatcagcacgtgcccatcgacatccagaccagcaagctgctcggtaggagggggcgccaccgcgcagctggctgtcggggggaggcctgtgcgttgccccctgtgtccaatagccgggagctctgacgcctgaaagcctgagtcgagatgctgaccactggcctcgttctatgccccatctgtggccagacctgcttccctgatagcagcgggaacgaaccatatgtacagtctgtttgacctgcgttttctcctttaataacatatgttatcgtatcattcagggacaggataaatgactcgctttaaaaacagtcaaccactgccgggcgcggtggctcatgcctgtaatcccagcactttgggaggccgaggtgggcgaatcacctgaggttgggagttcgagaccagcctgaccaacatggagaaaccttgtctccatgtctccatgactaaaaatacaaaaaaataaaaataaaaagtagccgggcatgggagcacatgcctgtaatcccagctactcgggaggctgaggtgggagaattgcttgaaccccggaggcagaggttgcggtgagcagagatctcactattgcactccagcctgggcaacgagagcgaaactccatctcaaaaagaagacaaaaaacagtcaaccactaagtggcacatctgaattggaacttaagtctgtctgacccactgtccatgccttttgcattatgccaggaaaaaaaaaaaaaaacctcatttaaaaagcttccacctcccccttgattttaggaggaagagggacctaagacccagttgcaaatgaaaaccttttagtgtccaggccatctccaggttgtctgtatggggcttacatacttcctccccagttcatagtcagggaaggcctcttcatctgatcacacagctcctggcattttaaaatgcttattggattcatggatttgatgccaatcttgtccttaagatggtgtctgtttgactaccccagtccgttgcttctagttctgtgacatcaacagaatttttctttctgaaaactttacaggaatatagcagagagagtataactgatactagtgtgggaccccagcgtttgaccggttggcagagttcaagttctgaattcaccactctgtagtgccatttagtcagtcctgcttggtggtcacgggggaagcttctttagcctcccttcagatttgtactggcccttcagcccatgtgcagtcttggtgtgtgagcttgttcttggtcatgaaaaggaccaataaaatgaccaccattcattgagggttttttttttgtaccaggtgctgttttaggcacttgacatgataaaaatgatcactgtcattttttgagtccttgccgtgtctcaggcacactgttcagtgttttacctgcattcccttttctagtcagtgtcttattattccccattttacatgtgggaaaactgaggcacagaatagtagacttgctcaagaaacttgataacgagaacccaggaccatctgaccacaaagctcagctcttagctctcactgaggaaatatgcatggctctgaagccacaaatctgggcccagactttgagaggtcagtcccattggtattcacatgtacagggtggtacttcactgttcacaacagagtcatgttatctagtccttagggcgctgtaggtattaggggctttgcagctgttcattcatccagtacttggcataaccatcttgtattttccattgtcatggttaaccccagccctgaggaaatggaagttgagcagcatcctcttgtcaggaagaaagatataattacccatagaagcaaaaatattatggggaattgagaatggtcaaaagtggcactttcaggaccaatttaaaccttttgttatccctgtgttgaggcaattgctctataaaaatcacactgctaatgaagtcagattgtcagagcctggtttagccccaggcatctctttgggcttgtctttattcccatcttcccatgacccccatactttaaccaatgtaaagaaaacttttagactaatttcagtgtatttcactcgaattagtgatggaattttggtgatgtgaatgggaatgctctaatttgggtgcttctcatgtagattggctggtggacagaaggcactgcagcctgaaatggcagagtctggtgctgacgatccgcgagaagatcaatgctgccatccaggacatgccagagagcgaagagatcgcccagctgctgtctgggtcctgtgagtgcttaggggctgtcactggagtcccctctttgctgaggtagtatgtatcagctgagctactctcttgttatttagccaccagggctggcctttagagagggagcgatttttatttgaggtatagatgctggcttcttccactatgaaatgatttagggaaaagctacacactaaagttactggcagtatattatacatgaatcagccacctgcagtgcccagagtaggtgaagaagatactttagttctcgaaatcccgtctcttgctttctagacattcactactttcactgcctaagaatcctggaccttctcaaaggcacagaggcctccacgaagaatatttttggccgatactcttcacagcggatgaaggcaagtgtgggccaagggccggtagtatgtggttggggacatccaatccgaggagtcatagcctctgtggtctctctgaggctccagtggggatgcctacatagaatatttcctgaactttcactctgtctctatagtttactccaaaagtggatcctatccctgagtttaattttcaaacccactgctttagggattgcctgcactcttaaagtgggtggtccagccagcagagttgaaagaaggacaaggagtttgtgtttgatgtgatgtaaaggctgggagaacttaccctgtttagggattgagctgggatgtggctgtcgagtgcttttctggcttaacattgtttttctgttcttactcaggattggcaggagattatagctctgtatgagaaggacaacacctacttaggtaaagtggcccggcctgggagccctggtatccatggggaagcccactctcagagttctgagataccaggcttataggaggcacagtctgtgagtgggaagagactggagtgtagatgttgcccatttgtaggtggtaaaatcaattgtttttgatggaattgattttccctgagtggagtgctgggggaaggaggaggtccaggccggtagtggccattcgccgtgcctcagcgagcaggtgtgtgtgggtcctccaccactcacctcttggttagcgggagtgtgctgcccccacccccacccccgcacccccattctacacaaggcagaagaggcacgggttttcctgggagcgaatatcaagtgcctgagagcaactacaggactaactgtgtttgggttgggtgtagtataaataataataatggctaatatttcctgagcatctactaaatgcaaggaattgtgcttggtgtgtcatgtggattctctcttgcatcttcatgataaatgttattgtcgctgttttaccgatgagggttggattagaggggttaaacaacttgtcttaggctccacagctgggaacaagtggggctgggaagctgacttcgtgctcttcaccaccacaaaggatgtgtgtgcatcctggggcatgcctgcctcatgtgggggtgtcctgggctgaatttcctgggcacttctcagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacggtgagcggcggcagcctcttcgcagccagaggacacctgggcccctgcttgtcttcctctgaccccgtctgacccctcagcctggttgcgccccctttgggccagtgtcttacttttcttcggtctttggatgttttcttcaatctgttggactccacctcttctcccctctctagggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagaggtagagaggcctcagcttctcctggtgggggtgctttgcctgtgttccccagctcatgacccttctccagttgtcttgttcccatataacatttgaactctttacacacctgaacctgtgggggccttgcccatttgaccatgtggcccaggccaaagcccagtgttggccttacgcatggtcggcaggagagtcagttgtgtgctctgttgaagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcggtaagatgggccttgtgatgagctgtaggagtggagtgggagctgcttgtcccctccccacccccaacagcccaacccaagacccagagagaagaagggaggatttctgtgagagtgactgtaggtagaagggcccaggaggccctactcctttatttttctgagtataggtgagtgagtgccacagaggctttgcaaggtggttcgctttgaactcggaacctccatcatgtgagctctctgaagatgggctttctttggggtagcttagaggccactgcatttgaacagtgtgctctctacagaagcagctgaggcctgtgggaaggcagccccaccctcctttttaaattaatttatttttgagactgggccttgctctgttgcccaggctggagtgcagtggcatgatccttgctgactgcaacctctgcctctcagcctcaagcgatcctcccaagtcagcctccaagatagctgggattacaggtttgcaccaccactcctagctaattttttattaacatctttgtagggacaggattttgccatattgcccaggctggtctcaaactcctgggctcaagcaatccactatcctcggcctcccaaagtactggggttacagacatgagccaccatgcccggccctttttaaatccatcttccatgagctaacactctctttccctttccagattgactggggcgactttggggtagaggcagtgtctgaggggactgactctggcatctctgccgaggctgctggaatcgactggggcatcttcccggaatcagattcaaaggtgaggaggccttctcagtctgtctctctctgatcactactctaaccataagaaaagtgtcatttgtgtctgtaaaggcatcacttgaagttcatagctctaagaccaggtatagtccaagggaggcagagtttcacacgtcacatgtcagagttttgttttgttttttgagacagagtctcattctgtcgcccaggctggagtgcagtggtgcaatctcggctcactgcaacttccgcctcccgggttcaagtgattctcctgcctcagcctcccaagtagctgtgattataggcgcccaccaccacacccctctaattttttattttgtttgtttgtttgttgagacagagtctcactctgtcgcccaggctggagtgcagtggcatcatcttggctcactgcaacctctgcctcccgggttcacgccattctcctgcctcagcctcctgagtagctgggactacaggcgcccgccaccacgcccggctaattgttttgtatttttagtagagatggggtttcaccatgttagccagatggtctcgatctcctgacctcgtgatccgcccgcctcagcctcccaaagtgctgggattacaggcgtgagccaccgcgcccggctaatttttgtatttttaatagagacagggtttcgccgtgttggccatgctggtaactcctgacctcaggtgatccacctgcctcggcctcctgaggtgctgggattacaagcgtgagccactgcgcccagcccatgtgagagttaaattttgatgtcctttttcttggtgtttggtacagggtgtaggggtaaaggcaggtgggaacactacagagcagggatgatgggccatactgccatttttggcacctaagtcagggctgcaaatccttaatagagttggaatgtgcagtcattgacctcatcaagggctttggtttattctggctccttggctcaggaaaattctccccccattgctgtggttctttgctctccttccaggatcctggaggtgatgggatagactggggagacgatgctgttgctttgcagatcacagtgctggaagcaggaacccagggtaagtgcaccatcccctgcagccctggcaaaagtggggtgctcaagggcccccacgtgtctagaaacaagaaatgcagcgctaagatgaggcttcttgcacatttaactgtttctcaaaaccttgatgaggatgtgagctgagggggaccaagagaggttttttttttttttttttggagacggagtttcgctcttgttgcccaggctggagtgcaatggcatgatctcagctcgctgcaacctccacctcctgggttcaagctattctcctgcctcagcctcccgagtagctgggattacaggcatgcaccaccacgcacagctaattttatatttttttagtagagttggggtttctccatgttggtcaggctggtctcgaactcttgacctcaggtgatccacctgcctcggcctcccaaatgctgggattataggtgtgagccaccgtgcctggcccaagagaggttcttaaaagttgagagtttagaaactctcaactttttagagaccacatgtgggccagctgttatggtaggagggctctagggggatcggggccctggagtgtgacatgacccccgccccaacagcagagaagacgtagtggtgtctgagccactagagggcggtgcaggatgaaactttacctcctgcggtccaccagagcagagagccggcctttctacccctctgaacccagctctggtcctcctctcagtctgggagttggaaagtggtacctgattagagctgagacacctgggacaaggtagccttcccccttggattagaacaagaagtggctttagcacagtgagtctgtccgtattaatcctccagggcttctcacacttgagggtcttttccttctccagtcctctgatcctttatcacttctctgtctcttcctggcagctccagaaggtgttgccaggggcccagatgccctgacactgcttgaatacactgagacccggaatcagttccttgatgagctcatggaggtactgtcatctctggaagatgcaggggggaggcatggcaccagcacaggtggcttcactccagatgcctgacctgacccctcctgtttgtgtgaagggtgtgagtgctatttgtgtcctacagcaggagcctcacgtattagatgcctcctattcatccagttacttatcaggtacctcctaggcacctggcactaccttaggcaccagaacttgggtggtgaataagacagtcaaagtccttgacctcatggagcttatattctaatggggaatgcagactggaaagaagataaataaataaaatatgcaggatgctagatggcaccaaatgccacggagaaagagaaagtaggggaggatgacgaggatgttggaaagggctatggttttgtatctggtggtcagggaaggcctcattgagaaggtgacctgtaatcaagactgcaggcggtgcagagagaaccatgcagatgtctggcagaagggcttcccaggcagagagagcaagtgcagaggtcccgaggtgggagcagaccttgcacagttgaccagcaacatggaggctggtgtggctgaggagagagagctggtggggagtagaagagctcagagatgtagcgtctgaaccttggtttgcctctgagtgaactgggaagctgttggaggtttcgagcaggttaggaacatgatctcatttgtgtttaaggatgatccctgtggctaaggtgttgagcagcccagcataaggagccagcgttcttggacctttgttgtaaggctgggaggacggggtcctgtctttgttaatctctgtatctgctcccttcccagtagcctgctggttcggagagcctcctgaaagttctgtcctcacccagttctctcctctttctgcccagaggctcctcccagcctcaaggggagaggacaaaagatatctgtgaagttttaacggcagaataggattgataagttaatatggctggctcttgtattcttttcagccttgccttaatccagtgcttctcaaacatgtatttctgttccctgaatctcattcctcccatggagacaaaataaataccttccctgggcagagagaaccctttgagtctctgtattctcagttatctgatcccaggctggggagaaaggacagaggtctggggttaggatgagataggaggtggggactgaagggtgacagtagtctctcctagcgcttacagtgttcagaggaaactccttacccagagtctagccctcatgtctcatttttgcatttcgagtagtccgagggcttagattctgagttcttctctcagtttgaaccaatttatcttctttttttctttcttcctttttttttaaaaagagtttctctgtcgcccagtctggagtgcagtgcagcaatcatagctcactataacctcaaactcctgggctcaagtgatcctcccgcctcagcctcctgagtagctgggactacaggcatacaccaccatgtttggctaattttaaacatttctgtagagacagggtctcatcgtttcccaggctggtcttgaactcctggcctcaagcgatcctcctgccttggcctcccacagtgctggaattgcaagtgtgagccatcatgtacagcctgaaccaatctttcttctgtcctcagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtctggcttccccttgatgcaaggctctgccatcttgagcagctctgcctccttgtattcctcctcttgttccatgaccccttaaaccccatccctgcctcctggccattgccatccactggggataggggttctctttgggacaagagggggaggtttcacatatacaggaagaatctgcttgcttcctgagtaggacaggggaactgggagtgggttttccttaaaaggaaagggtttaaggatgtgagggtaagcggccagttgggggtttggtttcccgagcctctcacctccccagcagctgaatgggaatgctcaggatgcacagctaacccagcactcacctgagtgccccgcacaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctggtgagatgggaaagggaggcctgccagtgggaggactcccagtctgtgcaaaatgaggccctgagcacccctgcttctgcccacttggtatcactctttcagattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctaccaggcgaaaaccacagattctccttctagttagtatagcggacttaataaaagaggaaaaaactcttgcttcagta

SEQ ID NO: 8837 - DNA, 320 bp, Homo sapiens
agggccgggcgcggtggctcacgcctgtaatcccagcactttaggaggctgaagcgggagaatcacgaggtcaggaaatcgagaccatcctggctaacacggtgagacctcgtctctactaaaaatacaaaaaaattagcctggcgtggtggcgggcgcctgtagtcccagctactggggaggctgaggcaggagaatggcgtgaacccaggaggcagagcttgcagtgagccgagatcgtgtcactgcactccagcccgggcgacagagcgtgactccgtctcaaaaaaaaaaaaaaaaaaaaaaaaagaaaaggcata

SEQ ID NO: 8838 - DNA, 1353 bp, Homo sapiens
ctgcagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagttgtggttggtctattctttatttctgaactaggaccaactccctaccaaactgttttgactccagagcctaataaatagaggtgtggtgc

SEQ ID NO: 8839 - DNA, 4183 bp, Homo sapiens
gggcaggtaattcctagaggcagctggcagtttaggatgcagatattaaacaaacacaaggaatcgacaagacagatgaaaaagaaccaagacaaaactcagtcccttactttttcccaagaaacatgcttgagattctgctgccacctattggtgattcctcttcaatacggctagagtcacaaaggctaaattggaaacccagtcaagatttccctcttcaaaaaaaaatcacccagtcaagatttcccttttcaaaaaaaacttttgctattgaagaccactgacaggaaagaaatatggtacccaaaaggctgcactacagtttaaaaagcaacttagaaggtagaatattttgggggtgggggtggtgtgtgaaaggcaaactaagtctaaatttaagaacagggacattaaaaactttattcaataaatacaacaaataatttaaaaatatatttcaattccaaagccaattaagaagaggaagtagagagaaagggaaaaaagtggggatgaggaaggtagaggaaaagagaaagcggccaaacaatggtttggttgggctgtgtttcagagtataccaccctttaaaattctgatcaaatactcttgacccataaacccttagcccttgttctgatggggtagccacaggagtccaccagctgggaatcatccactgagctctggatcagagcattctagaggctggaatgtcgggggagttttaggggtagttttccggtcattcctaaaaccatccgtcctaactcccaggcaggtttaaatagtgcaaactcttaggcagagagctcccagctgcatagtttcacaggtgagtgtcccaagccagggcctccaggaaacaggtcccagagtacccaggggtccaaagccacttcggtgaatggaaatctaaaggtgaagagaggggaggccagggcacagagtaaagctcctgggctaagccagtggccaagccagaaaacaatgctgggcagaaaagggttacaaggcaggtagtctggacactggattcaacagcttgccatcagccagggaaagtgaagctgaggatgcatatggagcagggccaggaagatcaggagagctgagggagaacaggaaaattgggaggaaggaagaggcagctcagcagcaaactccaggagaaataaccagcagccctcacagatttgtgattgtctcttaaaaagatttattttctcttcttgcctgaatgtacaaaggcaaaaagagtacagtttgtatatatatatatttatatatatatataaaaaaacaaggaacttggtaatgtacactttacagaagggaagaatcaggaagactgaaattaaattcaacagagcaacgccaatggaacaaaatctatgaacagcaacactgcccctccagcccgggcctccagctcgccccaacctgctcccaatgggagggctgagcaccaaggcaagcgggtgggctggggcaggaggggctggggacagggcctgggaggggcttgatcccaggaggggggcccatggtaggagatcactggaaagcttcctgggatgcccaagtaattaaaacaaacaacaaaggcccagaattatggggccaactagctgcccagttgcatcttgggggcatcagagtagacaaggggatggtgagagggtatacgggataagtgacatgggtggcctcaaagcctgtatgaaataattctctagccctctgcagtcttaactcgcaactctaagtcctgccatggccccttaaacgtggaaaaaagagactcaagaaatcaccatttcatttcatagggtgccctcttacccttctaagcgtgtggttctttgaccttgtgatgtgtggagagagttcggtaagagaaggaaatttcatacatgtacatgtacaaggcaggaaaaggggatgaagggaactgccataccttaaaatgaggaagtagttgatgtggatcctaaagagcagctctccaagccttgcctgatctatctggggatgaggccccctccctctttagcttctcctctatgggaagccccgtgagcaatgtctgtgagggcctgggcaggggtggctcataaacaggcttggtctggtggtcttggcccttggtagcaaatttttccagcctttgtttgtggggtgggataggatggggacccctgctgagcatctcatccctctgactaggtcatggatgccacaggtagctcccacctgtgtttctcctccccatgtagaggtgggcagcaaatctttcactcagcacttgtcaagaatctccacagctgctgcttcatgttatttcagagggaagactaggcccggcaggcatcaggatctgccatggtggctttcacctgctcttctgagcagctcctactcttcaggggagacttggatatgaggatcaaagagccaaatgtttaagaagaaaaattaaaaaggaaaagaaaaacctgttctcttctggagaacccaaggctgcccagctaatacagaagttcgtcctctgtgttacagaatgagtggaaagggcaggaatgcagggccatgcctgcccaatgcaaaagaaaattactcctaacggtttctttacaatatatacagagtatgctgcaggccagtgccacagatacaaaacacacaacaatatttaaaaacaaacaggaacagagagggaaccttggctccacctcacaggagccccaggagggcataatcaggctgaaattcagtcaccctcttggttggggtgactcaggtggggtgggatgacggtgtctgcactagctacttccacggaggaaagggaggtcactgctcagagcactgcccatgagggcagcagaaggcagagggaatgatgggtatgagggaggctgttttggggccctgccaagaggtctaaaacaatggtttttggggaggactcagaacccaacttgaacaaaaacgaggaggcagaaacctagggaaaaggcctgtagatcagaggggatcctcttgagcagatggtgaccctaagcctctcaagtgtagggttccagggtccttggaaatcaactactactgggcattgtgcttactgtcccctatttcccattttccaaactgagtcggagccaagttcctgctcctagtcacttttggcactctggtcacacactcccttttccagcctacactggtgtctgtcagtctttatctctctctctcaatccagagggtcatggaaagataggaggggagaacagagggatgatacctcaaaagccaagtaagctaagctccccacaccttggggaagacatgaccccaataaagctaccaaatcatcctcactttcccagtacaaagagtataaagcttccattgggagactgcatttctaaggagagcagagaaatgttggctgcctcaaagcacagctccactgagtacattctgagactctaataagtaatggcttggatgtgttattccagggtctaaggaacaaataacctcccatggccagtggcccctcaaacaaaatatgtgttaccaagaaacacagcttatattggcccacatggaggttatagactgagctatataaaatcatgtacttgtagacagaggaattgggctgtatatatctgtggcctcaaatgaggaagatatcagatggctagatgacaggacatctccaagaactgctgggtgctcccaggggctgccttctgggccttgccctaaggtgacctggcagactccaaggttccccaagctggggggaatactagtttatctgcctgaggcttaagagccaagcagtggaaaagaagaggcaagaccagtgtggggatccccctgggaaaggcaccaaggggttaggagggaagggaaaagggcaaggagttggggaataagaagcagcaggacttagtggggacgcaggttctacttcacagacgtcattcatgctccagcaccagcttgctcccagtgtccctggggagccctgtgctggtgttggaacccctgccccctgcctcacaggcagctcaaggccatgttggggcagatgccttggtcttcctttccaggctaggttgtgagcgtttatatgtgctcatgtaaatggggagaagtctcc

SEQ ID NO: 8840 - DNA, 362 bp, Homo sapiens
ggaaagatatctcactggttggtggcccgagagaggcctcttatgcttctaagatccaatggatctgtcccacctcttggccctctggtgccatcctgggcttcactgctgctggacatgctgttcttccccttcacagactacttcctttcagtcaccttttcagtttcttctccatcccccacccatggcctccaactctgcagccctctgctctcctctctctgtcttgtctccagagttccatcttctcacccgacctggaccattactcccattcccacaggcactgcagctttttttcagaactgaaagtttaaattccccctttatccttctccttcttcccctacaaccaaaaa

SEQ ID NO: 8841 - DNA, 10887 bp, Homo sapiens
tcaatttttcttaaacttcaactttatttggaccaggaaatttttccttacataaggttgacatgttttaaacaccttaggacaaactatttaaaaagcaacattttttatttcagaagggtcttgcttaagtggttttctgaattcttctcgttattatgaatatgtgctttataaataaatatattgtcggttactccattgtaatcaaatcagctgactaattgctatctgtactgagttatctgagatcagaagacttgatgcaggtcatttaaaattcacattagcacagtgtctatgagaaattgataatacagattaatgtgatatttacctctagtttgttttcctaatggcttccatgagaaggtcctcacaataaattatataacagtacagtacatttgtttggaaatcgtaaaaataattctacaaattagctccatatattatgttgctacagtatggtttaaatgatataaaataattagtatgtcaaacatcttcttataaacatattgcttttggtcatacactgaactgaaatgtacagcataaattcctttttttcctctcctgaatggcacaaaacaatggcttgatggtagggaaatgctacttcatgagaaagcatggtgcccatcaactccaacagtacctgtatttgcactcaaaaataaaataattcttgtgttgtcttgattgtatacaatttttgataactccagaagatgacacagtgttactttattagatgtatatagtcctttaggcaagagatacatttaaaaaattatttgaaaatcaagtttcttcctacataaatcctatcacacatgggctgggtgagggcttggtaattaatggaatttttttgtaaaatgaacaatcatgtcaagagtagtttttatgcaaatgcagttttccctactctgctggcactacctggggcacatcaatacccctacaacgcaccttcgtcactgaatttctgtctcatttcggcacgaaatgagaaccaaccctgtatcatttcctgacatcccagtaagctttctgactgtaaatgaggtatagtcctgataggtacagttacaggtatatcatttctgttggtgtcttacattacatttcataattgtatagtaacaaaaaatagaggtaacaagtagcattttgttttcatgtaacaagaaatggctgcaggttctcagtcagaacagaaacagagagacaaaagaaatggttactattcccttctatagtgcataggtttttttacacaatttgtcctttacccatttcagagaaggggaggaagagtaattcacagcatttgctagttaaaatttgttttttcagtcctctagttttctcaactgcacatcagctacttgattttttttatgaatatgtgtttggcttccccagggaagttgcttgctggtaaacaaacgaaagcataaaaagaaaaaagcgaagtattttctgaagttgggccctataaagtattagaaaaacaattttataatgtgcaataatcaggtaactaggtttttcagttaaaaaatgtaatgaccttatataagctagattactgagactatggtattaaacaatccatttgctcctctaaggaatatttacaatttaaaacctgctttccagcaagctgggccaggtttcacattaatttacttttcatatataatacagaaaatgaaaataaatattaaccttatagtaaaggactcatctctgaaaacacatgttctgatgctttagataacgagttgagaatataatacagaaatgaattcagcttcaagttgtgcttgcatatatattttctgaagctttgctgccagcttgttaacaggaaaagaccacctatcacatccacatccattatgtgcttttctcatgcccctagggatcatggtgcttggtcaagtatatatttgagtcaaattctccaaagcataaattactctccgattttaggttagggccctttggaagccatggttatttgttcagaatgcaacatattattaatacaccaaggcaataatttaccaagtcattaggttgaaccatatgaaagtgtctatattcatttcacctatcattttaacctataaaaatgatcacttggctgggtgcagtggctcatgcctgtaatcccagtactttgggaggtggaggagggtggatcacgaggtcaggagatcgaggccgtcctggctaacacagtgaaaccccgtctctactaaaaatacaaaaaattagctgggcgtggtggcgggcgcctgtagtcccagttactcaggaggcttgaacctgggaggcagaggttgcagagagctaagatcgcgccactgcactccagcctgggtgacagagtgagactctgtctcaaaaaaaaaataaaaaataaaagattacttacatatggttcaatttgtcattatcctggaaccaatagagagtagtttgagccctaggagaatatgaatcaatacactgttgagattgcattgcgttcactgatggtgaccttccctcttgcctttaaggcaaccataagtgaggcaaatgtaccatatagagatggatgagactggaccttttgtctttttctgtctccaaactgactttgtcatttttgaaactgctgtaaacattcctctcaatggaacagcctctgcccaacaaataaagttctcactcttgaaagaaactacaccagggttaggagatcaaatgtggcatgtgactgtgactttgtagatgagtggaacctctgccataactctttctgctccccaaattgtcctgagaatttggctaggacagaacattagtcattgactgctcctagccagatctggagaactgagctaggcacaaaattccatctcagttactataatcaaaaaccttctgctgctttgatacttagttttttggccatgcatcttggcaggaatgtaagtttgattgactgtgttaaccttcatgttgagagccttttgaagcagaaatctcttttattggtacacatacaacttgatttcaaaaatggaataaattagaatataatggcatagtataattaagcttggtttcatctgagatctgcaaccacattaaagggtgtcagaaaaattttttaaaatgtatttacttagagttctttcatctggggaacaaaagtaaaacaaagtgaattatataatataatagtccttttagaacagcagagtggtatccaaaaatcaaaccaatgacctactaagaaaagcagaggatcacttttctaacaacagtccaagaaggcctgaagtacctagtgagccacacttgaaatttcaccacttcataaatatctgcacacactgagtaaataaccctctatcacatagccttaaattgcacccctgttgcaatactgcattaatattattacatttttcaaaatctgtagaaaatattatctggaaccccaaaggaaaatcaattaatttttaaaaagttcattacaaagttgactgtataaaatgctaaaacataatccatatatacaaaatgctgttgtttaagaaaataatgggacccagttttagaataaaataattttatacaaaaaagcctactgcattcaaatcaatattttaaaaaaaaactttaaaaaagaatattgacatgtcttagttcagaagaataactataaagtgttgatttgcttttatgccctctgcacatcttgcaggtagaacaccagtcagctgagggaaagtatcctgcttctccctaggaagagattcatcaccaaggcagacagtcatcgccgagatgcgtacttggaagcccagtctgtccggccatgcactggctgggcggctggaggccgtggtatcaacccaggagtgcttctaggctgggtgtggaagaatggtcgcccaggatgaggtctcatggccttcagggaggaataacctgcaatgaaagaaaaaggccggcatgactgatatggggccaatgtaagcaaagtacaaataaatgcattttggtgacaaaaacatgagaaaataaggagttcaagaggagcatcttgtctcctacttataatcttctctactgcagttaaagacatcgttttaaagttgtcaggccaaaaataatggcatcattcttgacccctctttttttcatataccacatataatttgtcaggatatcctattagttctaccttccaaatatttacagaacctggcaactttttaccaactgaactactaccacgctggcccaagctagcatcatttcttacctggataatttcaacatcctcctaattggattccctgcttcctaccttgcccctacttcagtctcatgacaacagcagcttgagggagcctgtggagatggctgtcagatcacctcacttatggactcaaagccctccagggactccacgtcactcagaatccatgacaatgtgcttacaggcatcgtatcacccctgacctcatcttgctactccccctctcactcctgtcactcccacactctggcctccttgctgctccttgaatttgccaggccagttctgcctgaaagctcaagcacagaacaatctcctgtctggaaaagcctcactcatactgtatgcttgctcaatcacctcctccaggtctctactcaacaactcctttgcagtgagctcttctttagctactctatctaaaattgtaacctgtaccccacactccaacccccacaatccctacctcctgtctgctgtatttttctccttagcactaagtcagtaagcatctgacttactatatgttatatagcacttatttagcttacttattgtctgtagagtgcaagtttcatttattggtggatcccaggcctaaaacatgcctggcacaaagcagttgttgagtaaccatttgttgagtaaattcatgaataatttaaaatacaactcaccaggggaagggtctggaataggtgctaggtgtaccctctgcatagcagaaccgatttcttttttcagaaaggaagggacatagtttccagtcagtccactagaacttgtagagctggaaccaactgatttgcaaaagcaaaaagctcattattacaaagacatgtacccaggacaccaacaaggttaaatgacagcactgcagagcaataacaaactaagtttttacttttagggaaaagagcaaatcatgataaaaatgagttcagagccaagcatcccaccatactaccctgtcagaaagactgcgggggccaaagacagtgctgctcctgtgaggggcaaccaaatagagggtgggttggttgtgaaatttttttaaaaaagggaaatatgacatttgttctttattttcttttgtaaaagtagatttagactattctaaaatttgcttttttcactccataatatagaatagttatccttccatgtgagtacatataaattctagagtatggctaaaccataatccatttaaccattttcttattgatcaacacacaggttatattaaattatttagctgtgacaagtaattacacactaaatattcttatccacatcagaaaaattaaccattttttacaatgtgaaataccttaactttttatgtcatttccacttgggagtgctttaagggcagggactgtatgctactcgtcttggtattctggggaggataacagaatgccttgcatatagcagataatcaattaattttggatgggtgaatgaatataattcttattatttaggcttaaaggtacacatggaataatgaagactgttattattgcccgttatagaaatggaaattctaaccattaagaaaagtcagtaagtagtagagttgctctgttttcacaacacagagctttttcagcaattgtttaaggcagagtggaaacacagtctagaatgcctgcgtgaggagttgcgttggtcagctggggtgtattttgtactttggtgaatgaagaaacatgaagaaaaatgggaagagaatttgaacaggtaagtcacaaaagagaaaaaacttatagtcaataaacacaagaaaagatgatgaacctcattagtaaataggacatgcaagtttaaaccacaataggataccatttctcactcatcagattagcacaaattttagtcttgacagtaccaagtggcatcaaggatgcagagcaactcccatatcccgctggagagcaagtagtttggcaatatctgtgaagttgaagatgagcacaccctttaacctaaaatgttgactctggctgggcatggtggctcacacttgtaatcccagcacaatgggagacccaggcgggtggatcacctgaggtcaggagttcgagaccagcctggccaacatggtgaaaccctgtttctactaaaaatacaaaaaaaaaaaaaaattagctgggtgtggtggcacatgcctgtaatcctagctacttgggaggctgaggcaggagaattgcttgaaccagggaggcagaggttgcagtgagccgagatcatgccactgcactccagcctgggcaacagagcaagactgcgtcttaaaataaataaataaataaaaataaataaataaaataaaataaaataaaataaaatgttgactcctagttctcgtacccagaggaatcctcacacatgtgcataacaataggggtacaataatcatctcagcactctttctaatagcaaaaattgcaatcaacttatgtatttatcaagaagagaaggcatacataaattatggtccacataaataataagttatggtgttgtatagatatatattgtatatgttatataatatatgatatatatctctataattgctacacatatatttattaaaatgcatgaagcagtgatccaagattatcttcacataaattttaaaacctgcaaaaccacactatgaagtttatacaaacctaaataaacactcgatcaggctggcatggggggaggtaaggggaagcagggaggcgggaaaggcacagacactgggcttcatgtgtatttgccaagttcaacttttttttttttttttgagacagaatctcactctatcacccaggttggagtgcagtggcgcaatcttggctcactgcaacctccgcctcccaggttcaagtgatatcctgcctcagcctcctgagtagctgggattacaggcctgctgccaccatgcctggctaatttttatattttaggtagagacagggttttaccatgttggccaggctggtctcaaactcctgacctcaagtgattcacctgcctcagcctcagcctcccaaagtgctgggattacaggcatgagccaccacacctggccaaagtttgacttcttaagctgggtgatggctacacaggtgttgctatattatctctttcttttttattttccttaaattaaacaaacacctaatggatgaaggcagtgcacttggcagtgcagaggggaaagcagcacatggcaggggctgcctgcatcagggaaaaatgatgcaggaaacgtctctactgtgaacagggtttgtcagccttgggactcagtaaattcattcatccgtttaacaaaaaaagtggggagggtcttccaaactgtccaccttccaactagaagggatcttgatactctgggcctgcagctgggtcatcagaaggaggggacaggctggaacaaggcagacacagccaagggtgacttccacctcaagaggagggtgcctgctgcagccagggctttagccatcaggcctagtaagagtctgtaaaggtatttttgtttttcccttgagccagggatgactatgctctactccccagctaccctggaaggcagactcccctgggagctggctgagtcccaagggactgctgccgagaaagagaggaggatagggctggaaaagaggcctgagctttcagatgacaaaggcccctgtgcttccaaagcccgtcccatgactccttgtgcccaccttcctgcatccagggaatttgctttttgccatttaggggttaatgatcattactcacctgaatttactttgctgattactgacattgtccctgaagattttccagacaagccagaactagaccatggattaggtggaataaattccttgcctggattcgagagtatgccatttcttatactgatccctgatagagaagaaatgattttaaaatgcaaaatacacaatgaatcttacactagactacaaagataaaattaatgcagaactcaatttgtcaaaaactctctatgatacaataatcaaagcaaaaactgactgtgatgatgtcatctgacagatgtccgaggaaagatatctcactggttggtggcccgagagaggcctcttatgcttctaagatccaatggatctgtcccacctcttggccctctggtgccatcctgggcttcactgctgctggacatgctgttcttccccttcacagactacttcctttcagtcaccttttcagtttcttctccatcccccacccatggcctccaactctgcagccctctgctctcctctctctgtcttgtctccagagttccatcttctcacccgacctggaccattactcccattcccacaggcactgcagctttttttcagaactgaaagtttaaattccccctttatccttctccttcttcccctacaaccaaaaagaaataaaatagctctctgattcactccctgctcctttttgcctgtggtcactgtaattcgaggcttggccactcatactggatcactctatacctgtcatctggatctctcttcttccagatcatcctggggcctgtcaggccaatcttctaagaacaaaatgtcaatcctgatgaagtctagcaatatttagaagccacattccaaaccagagggtgaggaatttcatgcatcaagagggcctgccattctcaccccattcctcccttctgactccagctcagcctgtgccgccatctccctcacctggatgacagctacagcttgctggcccctcccctactcagcacacaggtgttgatacaaccacatcactccttcagttaaaacccttcagggacttctcatcgctcatgaagcaaaatccaaatttcttacaaggccccaaaaatgcctcatactacacattacgtcacctcctttctcactatgctctggccacactggcttctgccattcctctcacaggacaagccctctcctgcctctagacctttgcacttgctgtttcctctctccctggtgtgctctgccctcagctctctgcacatttggttccttctcattctttggggcccagtcaagttgcttattcagagaggccttacctgaccattcttttacaatctgtgattactatttgtctatttgttaaagtctctctcccaccactagcagataagctgtgtgagggtgaggatgttgtttgcaaagctgctgtataaagctgctgtataaagccactgtgtagactacagtgtgaaggaattccccagggttgtgtgacccagtggccctgcctggctgttttgttcacaataatattcgcagtgcttggcatgcagtagatgcttgatacatatgtactgaatgaatgattcactaatgctgtaagtttggaatatagaaaatcaggagagaggcttggatacccaccaaactatagcattgacatttaacccccatagtactgccaggacagtgtgactaagctcctaccctggtttccctattggccatttcccctaaacctggtctggtagaggggcctcagacatgccgcccagcttttgccagttcctccctccctggaggctggacccagtttcctataccatatttcttatcttgggtgactataaaagataaaaatgtgaggcctgggcccaggcacggtggctcatgcctgtaattccagcactttgggaggccgaggctggtggatcatttgagatcaggagttcaagaccagcctggccaatatggtgaaaccctgtctctactaaaaaatacaaaaattagccaggcatggtggtgggcacctgtagtcccagctactcagaaggctgagtcaggagaatcgcttgaacccaggaggtggaggctacagtgagccaagatggcgccattgcactccagcctgggtggcagagagagactccaactcaaaaaaaaagtgaggcttgggcttcagcaaatatttctatgatgttcccctcagttctgaagggaagccccctagtatctgccttctaaaacagaacctttgtgaatatgtgattccaaggacagggtttcttattaataatcaaagtaaagccaagtcatttatattaccaggcaagtatcgagagtgcttcaaatagtgctgcttggctgcagatctcagggtgggcgtgtctcgccgctgatatgacgtctgggtgggggcactgtttcctgtgcccacaggctcagagggcttcaggtccaaaacactctcaaacctgaatgaagagagcatggcttgggtcagcacgagagacagtatgtattctcggatatgtacccataatctcatgaattccagattcagtctgtttacaaatgtgagcagcacacttgcctgcagagagtgtcatcactctgtcttttcttgtttttcaggtcaatcctgctgagggatggactgaaatccaagtcatccaagtcagcccaatcatctgaatcctttgttgacctggaaataagaccccaccttctcctactctttgg

SEQ ID NO: 8842 - DNA, 259 bp, Homo sapiens
ctttgctgattactgacattgtccctgaagattttccagacaagccagaactagaccatggattaggtggaataaattccttgcctggattcgagagtatgccatttcttatactgatccctgatagagaagaaatgattttaaaatgcaaaatacacaatgaatcttacactagactacaaagataaaattaatgcagaactcaatttgtcaaaaactctctatgatacaataatcaaagcaaaaactgactgtgatg

SEQ ID NO: 8843 - DNA, 4070 bp, Homo sapiens
ttcaataggtttctctggccaaagtgaggcgaatgaattggggtagtaggggtagagaaagaaacctcttgtgtctgtgtaaattaaagtagcaccatgagtttgaagaatatgagtaagaaaaggtgaaatactaaggaggtaggtggtaaagcaattgctaatcagatcaaagggaagggaggaggaagaaaagtctagaatgatgccctgtccaacacacacacacacacacacacacacacacacacacacacacacacacacacacacttcttgtcttttttttaataacatgtattgtcatctaacaggacttttttatttatttgtctgtagattcctagaatgtaaattccacgagatcgaggatttttgcgcttttggttttccttttgtacatcctggttagtatagagtaggtattcagagaacacttgttgaatgaatgaatgagcaatgctttggtttctagttccataaagagcggagaaggaagacaaagtttggggaaaatgggttgacttgtcttttgttgctatgaaccatccagctggaaatacccactagacagttgaaaaagccattgagggctgggcgcagtggctcacgcctgtaatcccagcactttgagaggctgaggcgggcggatcacctgaggtcaggagttcaagaccagcgtggccaacatggtgaaaccctgtttccactaaaaatacaaaattagtcgggcgtggtggcctgttcctgtagtcccagctattcaggaggctgaggcgggagaatcgcttgaacctggaaggcggaggttgcagtgagccgtgatcacgcccctgcagtacaagctgggcgagaaagtaagactccctataaaaaaaaaaccgaaaagacaaaaaccaacccagtgaggactcagtagagagaactgaaatcggttgaattggtggcaaaagaatgagctcatccagagaaggtatgcagggtaagaagagaggtaagtcaaggaccactgggcaccccaaaagtcagaaaagtcgttttcaaaaaagacttaacagtgtatatccaatcatatttctagttctgatttaacagcaattactcagtttaacatgagtaggaagccatattttccagccttgctgaaagtggtcattctttttttcttgcttttagtttataattaaggaaggtttattgaacatctgtgctgaggtctactggatttactgagacataaaaaataaattataaaatccagttcttgccctcaaggagcttattttttaattgacaaataaaattgtatatttttactgtgtacaacatgatattttaaagtacagtcatccctcagtatctgtgggggattggtttcagaaccccctcagctaccaaaatcagaccatgctccagtcccttatataaaacggtgtagtatttgcatgtaacttaacacacatcctttggtttactttaaatcatctctagattttttatgttaacctaaataacaaacagaaagaggctctttaaaaatatttatttggaaattgaattttgcaataggaatatgcatgccatagtaaattatgtgtgtattcagggaggtaaaataaaacaaagatttttaaaggacaaaaatgacgatggcataattgttttaaaataagtatcctttgctgcaaagatgaataacaagggcaataatcccagtatttttttgtgtaagactgcaatggccattgtggaaggttgtggttcttatagtcttttgtgatcgtgtgttgttgttgttgttgttgttgttgttgtttgtttgtcttttggagacagggtcttgctgtattgcccaggctggaatgcaatggtgcgatcagggctcactacagcttcgaggctcaagtgatcctcccacctcagcctcctgagtagctgagactacaggcgcatgacactactggctaatttttagtttttgtagagaaggggtctaactatgctgcccaggctggtctcaaactcctaggctcaagtgatcctcccacctctgcctcttaaagtgctgtgattacaggcatgtacctctgcacctggcttttgtgattgcttttattagacatttaagccaagcacttgtctccatttgcttagttccaactggttgaattataccaaattgctaatatcttactgtttttaaccttcaaaaatggcagtttcagatgtccaatcttataaaatagaggcaacatcatcctagagttagggaaacaggagtgtaggagagccagggtgacagcattttaaaatcaactccatcttacaatgagaacacatagacacagggaggggaacaacacacaccagggccagtcggggggtgggggagtgaggggagggggagcattaggacaaatatctaatacataccgggcttaaaacctagatgatgggttaataggtgcagcaaaccaccatggcacactacaccatggcacaactacacgttgtgcgcttgtattctggaacttaaactagattaaaaaacaaaaaaatcagctccatcttaagatgtctacagctgaggaaatagcttaataatacctggaaggacaaattcctatgacagtagaatgtccagatgttccaatattgcataatgctaaacacctttaaggtaattatagtcatgctttcacgtatttacgcatgaaaatgccaaggatacctttctttaaattaacaaagtactaatttttttcattctgttagcccactcgcacgtagacattgcttagcttaccttttacagagataagacccctatcgaataaaaacaaagaagaggcattcctcctcttgctttctgagaatgctctactctgtaactgagtagctttcaataaaatgttacttctcatggcactgggtgactcgccttacattccttcctgtgcgagatccaagaaccctcttttaggatctggatcaggacaccttttttgggtaacactcagccttgttcacctgaaagtgtaactaaggtagcagcatgactgctattacacaggcttggggagaaatgaaaactcctgttataatagttctggcactctatgacaggtaccccaaaggcattttattcctttgaagcccctgacatcatcaacctacttgttcttgaagacccttagagttgccctcatcctgagacagtcttactcattttatctatctattctacctacctacctacccacctacctacctgatacattttcagaggccctgagaagtcttcttagcctcaacccttcactcatctgctcagtagtaggtaaaattgcttgcacagaagtcaagagcttcaaatctcagtttaagagctttgtatactcccagaagagggaaacatttgacttaaattcagccttagctataagcgattggtgtaagaccctattctaacaagtgggttttcttatcaggaaagatggttgagagcttgaaatggcttcttcagggtttctgaaggggcaacatgggcccaacgtgatgccaaaaagacaaatgcccatgactacacagtaaagtcactgttctgatggcgagaggcacacttagggattcaccaatgcaagtttgattggtagatcatgttcctagaaaatcctgtcaaggagtcaaagaatgtttagaaaatgaatttcctgtgacattctttatgtagttcatgaagttatgaacttcttttgaaggtttatattgtatatgagaatgtgctgtgaaaagctaaaagacatacaaggcaggttaaaatgatgaaatcaggaacaagaaactgtttccacctgcttttgctttttttttttttttttttttttttttgagacagggcctcactctgttgcccaggctggggtggaggggggtgatctgggctcactataacctctgtctcctgggctcaagtgattcccctgcctcagccccccaagtaactgggaccacaggtgcacaccaccacatccggctaaattttgtaattttggtagagacaggtcttg

SEQ ID NO: 8844 - DNA, 379 bp, Homo sapiens
atactaactgacacagaaagtgccactttttcataaaggatagacagttggcctcttcagacagcactgcaaagctaataaaaaatagaaccccttgtcaggttattattttactaaatctaacactcatttttttcttttgaaaagcagccaaagaggagcagaaagatctgggctcagttaatagcccagcattaacatattgaataacagcagtaatgtggataacaatctacaaatattaacacagcgctttatgcttttcaaaatatcttaaaaacatcatggcctttgatcctcatgaacaaccctgtctggtaggtaagacatgcactataatcttcctttgataaatgaggaaactgaatccatagggatt

SEQ ID NO: 8845 - DNA, 2378 bp, Homo sapiens
gcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggac

SEQ ID NO: 8846 - DNA, 2240 bp, Homo sapiens
gctcgctgtccgcgcccggctcccgccccgccccggcgcggggtgggttttgcacacccgttcccacattcttgtcaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggac

SEQ ID NO: 8847 - DNA, 1562 bp, Homo sapiens
ctttggagaacagctcacaccccagagggaagtggcttggacaaagggggctgctcagcagacttcgatctcctctgggggatgtggataccgctcaggcccgcacccctccattggtcctggagactgatatgggaggcggtatgtgccttggctccggagggcacctggagcacccctcacctggagaaccctcatccagagcactcctttcctggagcacccctcacctgaagcaccctcagttggagcatcctctcacctagagaaccctcacctggagcaccctgttacccggggcaccctcacctggaaaaccctcatctggagcaccttctcacctggagaaccgtcacctggagcaccctgttacctggagcaccctgttacccggagcaccctcatctggagcaccccctcacctggagcacccctcacctggagcacccctcacctggagagcccctctcctgcagaacccctaccaggagcatacttcaccgggaccaccccttgccttgatgcctcagcactgaggagtctcccatctaggtggctgggagggcactctggagccatggggatgaggaccagaggctgctggtacatcttgccctgagactttggaggactgcaaggggacccacattcacttcagctctgcacctgtggtgatatccccacactggagagcaaagtgattgctccgggggccagatggccacgccaccatccccccacacactgcccctgccccctgcctggagcacagcccgagagcacccaggatcatccatgtgaagcagcaggctgtgggtatgtttggccgtcccgacccctccacagccagaatgggcacccataggcatgagaacctcacagccattaggggtgccctgagtgccatgggcggtgggatttctctgatgccccccagctctgctccctgcctggctcgccccctatcaaggctaaggatgactcagggcccagccatcaccatagcaacacgcgtcgcctagcaatggcggtctcccggcaacggttgtctcctagcaatgggatattttcctgggccctggctggagcccggcagttatttttagctccacagcaaatcagtcggcagctgcattttcggctccttgaagagaggcaaggtgtgggggggtgggtctctcggcaaagggaggaaagcatccccaagataggaatcttgctgccgtgggcccggaggtgcaggcctgtgggtgggcgaggccggatcctgcctgtgcaggggggcaggtggccggtggaggggagccaggggttgtgcaggctgcctggatgagtcggcagctaggactatgtccttgatgggcccccaagcaccctgagcctcataggtcggctgggtagaggggacgcaggccagtgctcacagctgcactatcagagcatgtttctgggtggcccagggtctggcaggctcttggcacccagtgcccctcagctgtgggagccatcttcactgtcccagaccccagctccacccagggagggggcagcagggcggccgc

SEQ ID NO: 8848 - DNA, 8647 bp, Homo sapiens
ggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtaaggcccgcgacagagagtgataaaagtcgtcccagagccagagccaccgaatctcggagcctccaggcctcgataggccggagatacggctctaacatggggaagtgggaccttcgggattgtgggggcggggataggggagaggttggcaggggtgagggtcccctcgcgatatacccacagttccaaaattggtacgaggtcctgagcgctgatgtctgttctactcctccaggtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtacggctgagctaaggcatgtaagtcagggaacacaatgcctcgaacagagtaggtgtttgtgtacagagagctgttgacgttttggcttgttgactaattagcatgacaaatattttatatgccaggcactgagaacacagtaatgactgagagagacatttctgccctgtgggagcttatattctagaacatgttgtccagtagagctttctgcaatgacgagactgttctgatatatttaaaatttatatttaatagttcgttattctcattagtcacatttcaagtgctcagtagccaactatatatgactagtagagaaagagagagaaattattaagatgaaaataggctgggcgctgggcgtggtggctcacacctgtaatcccagcactttgggagaccaaggcgggcagatcacgaggtcaagagatcgagtccatcctggccaacatggtgaaaccccatctctactaaaattacaaaaattagctgggtgtggtggcacgtgcctgtagtcccagctacttgggaggctgaggcaggagaatcgcttgaacccaggaagcggaggttgcagtgagctgagattgcgccactgcactggagcctggtgacagagcgagactccgtctcaaaaaaaaaaaaaaagccctgaggcaggtgcatacctgttgtgttgttgtgttcaaggaacagcaaggagaccagtgacagtggagtgagcaaagaggaaagtgggaggagataaggacagagaggtgaggccaaatcttgtagagccttatggccattttaagaaccctggtggccaggcacggttgctcacgcctgtaatcccagcactttgggaagccaaggcgggtagatcacaaggtcaggagttcaagaccaacctggccaacatggtgcaaccccgtctctattaaaaatacaaaaattaggcgggcgtgtcggcgggcgcctataatcccagctactccggaggctgaggcaggaatatcacttgaacccaggaggcggaggttgcagtgagccaagctcgtgccactgcactccagcctggacaatagagcgagactccgtctcaaaaaaaagactgtaagggacaagggcagaagccaggagatggaggaaggggctagtacagtaatctagacaggagttaatggtggcttggatggaggttgtgcatgggagatggggaggacaggttggacacagtttcagtgggtgctaagtgctgtggggaagatgaaataaggtggtgagagaagttgctgctcagagagccctagtgtgatccaaaaagcctccccgagaagtggcattttagctaagacctgagatagccagccacatacagagcacaaagcatgaagctcttggtctcttggggtgagctggccgcagcagatgggaatgctgagtcaggcccctcaccctgacctcttcctcgacaggtccagcagactctggaggcccgagcagctgctgcagccacagtagttcctcccatggtgggtggccctccttttgtaggccctggtaagtaaagagtagcaaggtgagggggttgggcaatcaggcagggtggtaaaaaggtgtgcacaggactctcctcccaccatccttgcctctcccctcccaacagttggctttggccctggtgatcggagtcacctggacagcccagaggctcgagaagccatgttcctgcggcgggcaggtgagtctggggccagggacccccacatttaatcaggcactcttgtttacatgacttcagcctcttgcctaaatccttgctctaaattaccctttgcctttgatcccaacttgatgttgtcatcctaaagcacgaacctgatcatgtcctttctgatgatgtcaattttgttttaacctgatcattgcaaaccaaccctcctgctgtcagtcctaattcccagttaccacagcacttaacacctcataacaagctatataatttcttatttactatggctatcatcttttgcatcctctaaaataaaagctccatgaggggcagaagtctcagtatctgccacataggaagcattatgtactgtctgttgatgggatgaacggactgttgagacaagcgccaggcttttcccctggcagtcacaaccctacatgaccttgcttcttgcagggagagatccccagcagcccgaacatttctgggatgtgccagcagtgcttttgttaaggtcccttctctccctgctcactgtcacccagctgtaatcttccagccatccttcccccccaggccattttctacattccaccttttgttcttcaggtaacctttactcacactgtcaatttgtaggacattacttccttatatgtatgaaaaggatgcgtgttcttacttggatgtaaaattctggtataatctcggttaaaccaaacgtgctacttatgttacctaaatcctgttatacttattaatctgatgatctctgagaagttgtaatgtctcttactttttagtatggttttgatcaaaatgcaaatctgacctacttcccctgcccagcttccaaccctgctgtggctccccagtgccctcaggaggacacccatggctcagccaagaatgctgtgctttaagaacaaaaaagctctactggggtgcctgctggctgctcagcccttctcatgacactctctaagccccactacttctattacagttacactaaactgaaaagggaaaggttttgcttataaatattcttcctgccaataatattcccactcaccccttgcctaacacttcattgccccttgggtctcagctcacaggtccctttctccaggaagccttccctgggcctggctgggtcagagggctcccctctcttagcactgatcccactgcctgggcttccctgcttccagcgctggtccccactggctctccttctctagtgatgtctccattccctcctcctctggaccaggagctccctgagaaccctgggtctgttggtgtgtccccagcattgcctgccacagggctgagccagaggagcttctcagtggtaaattttcatggaatgaaccaggggagaggcccccacatctccaggagggctccccagactcttctccaggatttcttgatgctgagagtgcacacacacacacgcatgcacacacacaccttgtcccaagtgcccctgtcccccatgacacacacccccatctctctctcccacagctgtggccccccagagggcccctatcctgcgtccagccttcgtcccccacgtgctacagagagcaggtgaggggccagggtcatcatccctgccacataactccccccaggccctggaactccccactaacaccctgacagattccgctctctcctctgcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggtgagtgtgaacagggaactaacggtcagatgtgcggtggacggggagaccatccatcctggcccaatgggctatgtctgagttggcctctctcctgactttctgtttctctaccttctcactctgcctttgtctctgtctctttctgcatctttctgtggcaaaatctgttctctccttttgtgaagggagtacagagagaaacatgctattggaatatttctcttttgattgttactgatgttcttgtctgtggctgtctctctctgcctgtgtttctccttctctgtgtttgtctggctggagactctctgcttgggtgtctcttggctgctctctggcccccaggccctttctttgttggatggaatggagatgacagtaaagtctgagcctgtgagccggcccccctcatgctctcctcttacccacaggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtaagcagggagcctagcggtgaagggacagaagggacggggggcagacaggagcccaggaacttccacacagacagaccggacagcaggaggacctgggggagggaggcggacacatgtgccccacatccagaagcacatccagcccttactgtggtggcaggagggccggggaccaaaggacagtgggagaccccaataccaacccctttgcacctctcccctttcctctgcaggtcccagagcccctgggtgaagacaagaagaaggggaagccagagaaattgaaacggtgcattcgcacagcggcagggagcagctgggaggaccccagcctgctggagtgggatgcaggtaagctgctgaagctcgaggtcaggcgtggctcggccaaggtcagaccaggctgctgtccttgggctgcagactgggagggtgaaccctctcagtagggtgggcgctgttgttagcccaccttggggaggggaggctatggctcaggggctggttcttcacctagccatgggccggagcttggtggaggtgacggggacatggggctttgtagcctgttttactcatgaggtgcctggcttcagagagcattctttttttttcccaactcttaggataaaaattttttttttttttttttatgagacagagtaccactctgtcgcccaggctgcagtgcagtggcgcaatcttggctcactgcagcctccgccccccaggttcaagtgattctcctgcctcagcctcccaaagtgctgggattacaggcatgagccactgtacctggccgggaaaaattttaaacacagatggcacagtaaacacccgtctacccaccacctagattctgcaattaacattttgctgtgttcacttttttcctctttgtgtatgtatctggtttctttgtttttagctcagtcatttgaagcaagttataagtgaattaatcacttctaaatatctcagtatttatctcctaagaaaagagatattttggccaggcacggtggctcacacctgtaatcccagcactttgggaggcggaggcaggtggatcacttgaggtcaggagttcaagaccagcctggccaacatggtgaaatcccgtgtctctaaaaatacaaaaaaattagccaggcttggtgggaggcacctataatcccagctactcggttggctgagacaggagtatcgcctgaacccaggaggcagaggttgcagtgagccgagatcaggccactgcactctagcctggcaacagaacaagactccatctcaaaaaaaaaaaaaaaaagaaaagagatactttttgcatatcataatactattatcaagtctaagaacattaactaattcggtatcttcttttcagtttatattcgtatttccctaggtgtcccaaaactctgttagaactattaatgtttttgccctgaaccagcatgcatgcagttttatgtccttcaattatatctttttttttttcttttttttttttgaaacggagtcttgctccatcgcccaggctggagtgcagtggcgcaatctcggcagctcactgcaacctccacctgccagggtcaagtaattctcctgcctcagcctcccgaatagctgggactacaggcgcgcacgaccatgcttggctaatttttggtatttttagtagagacggggtttcaccatgctggccaggctggtctcgaactcctgaccttgtgatccgcctgcctcagccttccaaagtgctgggattacaggcataagccaccacgcccagcctcgattatatcttaataagaacggtctctttcctgcctctttgttttgtacatattttttgaagtgtccagggcagttgtcatgtatgatgtcccaccttctgagtttgtccggttgtttgctcctggcattgcctaacttgtgcttagagtgtcccatatcacagacgccatggggcagccgtgcaatggctgaggaaggagatggacccctcctgcttcagtgtttgacttccaccccctctcctgggaccgtctacctggcccagagaagaccctagctctgtgaccttgggcaagtcacttagcctggttttgttttgtttcttcttttgttttttttttttttcttttttttgagacagagtctcgcactgtcacccaggttggagtgcagtggtgtaatcttggctcactgcagcctccgcctcctgggttgaagcaattctcccacctcagccttccgagtagctgggattacaggcacccaccaccacacccagctaatttttgtattgtttagtagagatggagtttcaccatgttggtcaggctggtcttgaactcttgagctcaagtcatccacctgcctcagcctcccaaagtgctgggatcacaggcgtgagccactgtgcttggctcacttagccttttaagcctcatattcctcatcccctcccttgtggggacagggattcattgggacagagcatgttcagtggaagcacaggcccaactcagaggcagcatgagaatgtcagctgggtgcagccatggcggaggagcaggcagcatgtccaggtctcaagggggagttagggcaggccttgccaaggaagcagggctgaggaaagatgaagcccatgttcctgaggtgccatgacgggcagccagtgggtgacaggggtccaggggaccaagggacaccaaggctcagaggaaaggccagggctagggcagagttaagggtgttactacaggaatgagtgaggtggccctggggtggggagggcagtgcagttcaaggttaaaagtaaggactggagccagatgcctgagctcttgtcttagctctgccgcttcctgcttgtgtcactgtgggcagtgacttcacctctctgtgcctcagtgtaaaagcatggttgggagtgccagaaatggaaacacccctccaggtgccagcagagctcctggcgcagggtcagtaggtgttgaccattattactaagaggtccctaggcagagactagatacctccgaaaaggtgggatcgttcagacaaggtagacactgggcaaggcctctgcatcctctgatgtcatctcttccccatccccagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatggtgggtgcggcctcccctgggaactgcaggcgcggcaggcgctggcctaagcctgacccgagcctgccttgaaccctctgtctccacagggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttccacccctg

SEQ ID NO: 8849 - DNA, 105 bp, Homo sapiens
cttgagtccaggaggtggaggttgcagtgagccgaggtcacactactgcaatccagcctgggcgacagagcgagactccgtctcaaaaaaaaaaaaaaaaaaaag

SEQ ID NO: 8850 - DNA, 3565 bp, Homo sapiens
gaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctca

SEQ ID NO: 8851 - DNA, 360 bp, Homo sapiens
gacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctt

SEQ ID NO: 8852 - DNA, 1919 bp, Homo sapiens
caagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacgggaaacccatggagtttgccctttgtaaaaattttaaacacagtgtcttgatataaaaataaaaaatccagttagcactcccaa

SEQ ID NO: 8853 - DNA, 2510 bp, Homo sapiens
ggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccagaaatgtggaa

SEQ ID NO: 8854 - DNA, 1633 bp, Homo sapiens
tccaactttcatgtgctggtaaaccttttccacaatccctgtttacaacacaatataattataattcctcttaattgatatagatgaaaatagaattaacatgtgacttaaactgtttgctatttttatggaacatgaaagcacataaaagttctggttataatgggctactaggaattttactctatttgatatatttcttgctttttgatattttccaacaatttgttcttggcccttcttgggaagcatcagtcattctcaaactccagatatgtatttctaacttgaaaggttagcctggatgaatcccatcagcaccctgctgactgtgtctttctgccattgattgaagaccccactgggtctcttccaatgcaacactgataaaaataaaacctgatttccccatcagttaattgtgccgctattgacgcacgtgcctaaaagaaatcttgtgtcggccttcttcaaaataaatggtaatttattcagccattcattcaacaaattcatctctacatttattgatacctactgtgtgctgggtgttacagctactatgatgagcaagagagacaaacccagtcctcaagattattacagtatgacggggaagtcatactatgaacaaataattataaaagtcagtaattttttagtaatcatttagtaaatgctttgaaggagaagcacaggaagtgtaaaagtgcaggcaaacggaagttagacctacagggattccatttttgcccctttttattatatggagtcgagcagccaaagacagccctcttgccacctgctagaatgctcataccccttcccctggactaaaataacattcctctccttagggtgatatacaacgccattcatgcctagacccaagtataccttttcagctttggcttctaatgagcactgcatactagctacccagggccactcacaagtccctcagcagggaacacattttaatttctctgtccatttgcattgttctcactagcccatctacctgttgaactcctacttgctcttctatacccagatcaaatgtcatttcttccctttagctttcacactttcatagacacttggcctctacctcttcctgggtggcagtaaatgcttcctcagtcatgtgcacattcaagcacttagcaataggaccctgtaggatacagcaaggggtctggaccttggaatcagagaaacatgaggcttgagccttgtgtttgtgaactattgattgcaacaatttacttaagtctctggactttagtttcctcatttgtaaaatggaaagattataaagattgactttaaatgcaaaatgcttagtacagttcagggcatctagtagacaactaaaaaatgctcatttgcatactcttgtatcatattggattgtcatgtaactgtctgcttcccctgagaacaagagccatgtctttttattcctatgttgattctgccttgatttatattctaactaaatttcataagtattttcctcccaactatgtttctttcatgcaagaagcttttaaatctccacaacaaaaatggaaactcaattgattatacagattgaatgaaaaacaaaacaaatatttctagtaataaa

SEQ ID NO: 8855 - DNA, 7347 bp, Homo sapiens
acgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgtcattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagatttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctttgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcatgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatgtaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaagtacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaaaaaaaaaaaaaaaaagtcaagaaactgaaattcccatttaagttctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacaacttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcatgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaagtttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaa

SEQ ID NO: 8856 - DNA, 6107 bp, Homo sapiens
cctgtaatcccagctacttggggggctaaggcaggaaaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcgtgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaaggacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaaaaaaaaaaaaaaaaagtcaagaaactgaaattcccatttaagttctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacagcttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcgtgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaactttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaa

SEQ ID NO: 8857 - DNA, 7351 bp, Homo sapiens
acgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgacattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagttttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagaagcattcataatctgacctgagcatccacttggagaatgttttttttgtgtgtggtctggggtggacaaaagaccaccaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcaggtttgtttttcccgggacagatagtagtgatagtgcattatatttgaataagaaaaacaaaccagtataccttgagaaattttaaaaagcatagttgaggcatattttttcataattatatacttatctggttattgcccatggaatatttgtggaagaaagatttccttctgaatttggtactatcttcttaatttgttccaaagaaaatgctgccatactgcattccctctgcgaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgccacaaaacctttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcgtgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaaggacaaaacaaaatgttttggaaggtgatcctggctcctttggctctcataattgttttatagctgaaaataaaaagtcaggaaactgggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaaaaaaaaaaaaaaaaagtcaagaaactgaaattcccatttaagttctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacagcttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcgtgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaactttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaa

SEQ ID NO: 8858 - DNA, 4315 bp, Homo sapiens
gtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtttt

SEQ ID NO: 8859 - DNA, 6601 bp, Homo sapiens
gtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagttttggtgagcgtttgatttgtttgcacaaaatgtcagagaaacagctgaaattatatatgaacatgtacacgcccacacatctgctattatcagtcataaaatgtagctgtgtgtagctcatatatttttgcttgaagacgaatccgtgcagtacacttaaaagtaaacgagtctttaaagttttgatgtggctggtgcgaaaagtattctgcctgcacagtcagatatgactcagcacttgggtggggagttgtgggggcagggaagtgtactaggagccggctctgtactgtgttgatgagtgatatggcaggtgcccagccatcttaccccatcaaccccataatagaaagggcttgtctgcagcacctgctcagggtcaaaggggtcacccaaacgtgcctagaccctgtgtgtgaaatgatgaccaggaaccgccaagttcccagctcccgtcatgtagggtggatgggaattgccttaggaatgagtgaaagaaattaaagcctggtttggggatacaggtgataaaatcctaataagtatttaatttggcactttcaccctaagtgctgggaaagtgaaagacagactcagctttcttttagactaacaatctgttaatgctttcaatcgggtgagtaatacatgaatatggtcttgtaaatttatttcaaattgtatttgtttcaaatcaaattgttctgtcttaatcctacctcctcactgaggtaggagtttgcattctcctggactcttaatctgcagtgtgtgtgtgtgtgtgttgtgtgtactcacacagcagttttgcttttctgtaagtgccatagctctgtatatggttctgacttagcaataggtcacatatctttccatagcgactccacttcatgctaactactgcagcaagtgccagagcacaggcatagaatttgctcataggtatcccactcttgtggtacagggaggtggaagatcagcctcaacagactctggaagacactgtcaaagtggcagctccacttcacacgggccctggcagcacataagaacacccacttacccccagtgctgtcagacatgagtgagctggtgtctgcctgctgggtgaggagcaagtggtgctcatttgaatttttctatcaatgcagtaggatgatcttttcaggcactggtggcatttgcctttttttctgaaagtttttgctaatttttggttgagtattttttctattgatgattagctctttatacattctggacaaaaaaatctcttatatgttggaaatacttttccttcaatctgttgcctttttttcccaacattttattgtgaaaacttccaaacattcagaaaagtcaaaagagttttacagagaatacccatgcactcactacctagcttctacctttaacttttactacctttgcattatcatgtattcatttattaatccggcttattttttggtgcatttcaaaacaagttgtcaccaatactcttatccccaaatacttcagcatcatttagagttcatcaattttttataatttttttctccaaagataaaatttacataaagtaaaacatacaaatcctatgtgtgcatttgctaaattttgaccaaggatacagctgtctctcaaacccttgtcaagataaagaatactaccgtaactcccagaaagttatctgctttccaggtaatccctcctctcctgcccccattggtaacctctgttctgagattcttttccgtcataaattagtcttacctcttcctgaacttcatattaatggaaccataacagtatatggtcttttgtgtcgtgtctggtttcttttgctcagaatatgagatccatgttacaattatcagtaattttttcctttttattactaagtagtagtttattgtgtgaccaacccatgctttgtctattgtcttattaatgaacccctgagtttttcccagtttggggctatgatgaataaatttgctatgaatactttcatacaaagcatatgagttttttttgtgaacatatgtttttattttgcagcatgttttttaattgcttgtggtgtattttatgtagaagttgtcattttaggtggtgggtgcctatagtcccagctactcgggaggttgaggcaggagaatggcgtgaaccccggggggggaagcctgcagcgagccaagatcgcgcccctgcactccagcctgggcgacagagtgagactccgtctcaaaaaaaaaaaaaaaaaaaaaaaaaaaaaaaaagaa

SEQ ID NO: 8860 - DNA, 16424 bp, Homo sapiens
ggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatcttcacagtgagtgtggagggtacacggcagagcccggtcatttttaacaaatgcatgtggtttctgcagaaagcagaactggattgtttcgtctctattttttgaaggctgaaaatatgtatgtttatacatgcataacaatttggggtagataacaagtaacagtaaattatgggggtgagactgaggttctgtataaatggaaaaaaaaatctgattttatggccttctctctctcactctgttgcccaggctggagtgcagtgacaagatctccactcactgcaacctccacctccagggttcaagcgattctcctgcctcagcctcctgagtagctgggaatacaggtgtgtgccaccacacctggttaatttttttttttttgtacttttagcagagacagagttttgctacattgaccaggctgttctcaaactcctgacctcagatgatccacccacctcggcctcccaaagcactaggattgcaggcgtgagccaccgcaccctgcctgtgacctctgtgatgtgatttttctttttttaatgccagtatgtcactttcagaataaaacaagaactagtcaaggatgccacccccaccaccatgagcccagagagatcaacacagacccatcagaaaggagggagtggtatgaacatggagggccactggggttgaggaatggcctgagagtgggcatggccagttggcttaggttctgagcagttgctcattcaacaggcacactgagtgtgggctactgtgtctggtcctagggttaggatgagtggcaaaaatgacatagttcctgtccttggggagctgatagtctagtgggagaaacacatattgaaataattgcaaaagaatatatgtacagtccatggcaagtgctaggaagacaaatgacacagtgctctgaacatatataatgtgagggggaacctccttgcttgtgtgggaggtgacctggagcccatatctgaaggctgcattaggagttagtgaggcacgcaggagggaaggcacatttcaggtggaaggggagcctgtgccttcgtgggaagaaatatggtacattaggaaggcaggaatacaggtcttcctggagcccaacatggtgggagaataatgggaggaaagtgttctattccttctcttaggggagacaggtggacaggtgtctgtggtcaggggatgggatgtggctctccaatatgctagagccctggacagttaggggtataaggttgataaacatgaggtaggcctcaggcagacctgacttgaattcagcaggtgtgtccctcggccagctactggacttgcctgagccacagcatccctgtctgtggaatggggtcaaggctgcctcataaggctgtggtggagagatctgtggagccccgtacacttttcatcaatggctgatggattggcctgttaatactgtaagagtgtgatgaggacgctcagggtcactggaacgcctcataatcttttaaaaatctcaggctgggggagagcaaggaacccatggagatcttctgttccagaaaggtccaggccaggaagggcttaggaagagaagcagatggagaaaaaaatctaaggaaacagacccaggagttgacataaactgtttggagaggttgttccagcagactcttgcaccggcagccccttttcatgagataagaaagcctaggagggttgggggcaggagggcacccatgaaagacagggtgtctggatgttctactggggattagaaaaacaaaacataaaatttccatatactctgctaaaaagtccattttagaagactacatggttacagggagaaatacgcatgttatattaagtaaaaaaacactgtggatactatgattttgtaaagtaagtataaatatatatgtatgtgtgtagaaaatgccttgaaaaatattcatactcaaaatgtagctgtgtcctagcggggcatggtggtgtgtgcctgtggtcccagctacttgggaggctgtggcatgagaattgcttgaacctaggaggagaaggttgcagactgtctcaaaaaaagatgtagctgtgtccaagtcatgttactaatgattgtgcatatatatggttcttgtgacaagtacacattagcttagtgacgaagctgtcacatgatttttgaggtcaaaagtttccaggccaggtgcggtggttcatgcctataatcccagcactttgggaggccgaggcaggtggatcacttgaggtcagaagtttgaaaccagcctggccaacatgacgaaacccaatcgctattaaaaatacaaaaattagccaggtgtggtggggtgtgcctgtggtctgagttacttcggaggctgaggcgggagaatcgcttgaaaccaggaagcagaggttgcagtgacccgagatattgcatcactgcactccagcctgggtgacagatcgagactccctctcaaaaaaaaaaaaaaaaaaaaagagatagttgctagagagctggggttccaggggtgtgtgggcaagggtggggaaaatgttgggggtggtgaaggccctcccccactcacacccaccccactgcctccccaggaatgtaacaacccctgctgcaatgcctctaattgtaccctgaggccgggggcggagtgtgctcacggctcctgctgccaccagtgtaaggtaagtggcccttttctccacgccttgggccctggcctgacagtgggaccacaggactgctctgctggggtggatggctggggatttgcctccatcctgggctgtgatggcaacagagtttcagaaacacagagcggaaaaggtgccttgaataaaatttactattcctatactgggcctcactgaattcagatcatcccagaggagggtggcgcttctttggaaatggtacttttttttttcttttttaaagaagtatccagagagagtgggcttgattttattgagctcataaacaataataattatcatcatttgtattgacattaatggacctcttagtagatgccaggcactgtgctgggaattttatgtacgttatctcattctctcctcacaaaaaccccataaaatatatgtgactatccttattttaagatgtggaaactagagcttataggggataagaggtttatctggaatcaggcagtcaggaagggactgaatccagctttccctgactctggtgcccacattcctaatattgatgtgagagataaattgtctgttgctgctagtgttaccgtagaaccacaatctctcttccacaattctgaaattaagggagttctaaaagctgaaaaaaaatgtaaacacatttggtggcaaaacttgacctgaattgacatgagatgaattatagtctttttaaaaaaaaatcactcctaaagtgaatatttatattgcattacagaaatattaatatgtttgatcagaaggtgttatccccagccttgctggggggttatgtaatatacatatgtagttatatatgcggacatatgtaattatccatatccatatatatatatatatatatatacatacacacatgtgtaattatatatgtacacacatgtacatatggacctatgtattacaatatctgctttctaaatctgaaaagcctgaaccccatctggccccatcattttaggcaggaactgtgggcctgggcttctgcctagcacttgctgagtgctcgttaggggccagataccattcacatacttagttctaactcacgtttaatcacccattagtgggttattatcctgagttgtgggtgagtgagcacacacaggttacacagcaggtgcccaaggccccgctgccggttaaggagctgggatgtgtgcccaggcaggctggctgtggggcaggtcctctttgcctccacctgcctctggatggcagaggtgtgtcctgcagcctcctcctgcatacaccacccatgcccacacttgcgactgggcatccactctcagcaagctgctcagctggcccagtcttggcctgagagtggccggtggagaagcctgtctgccttctcctggaaggaccctgtgggtgggaggagtggcccaggagcaggggagggggtctgttctcagtcactggtttccttgcctggctctcggaatgtgcacggcatctggtttggctgtgcgtccccctgggaggctgtgctgggtcaagttcttccagtcttggcccaaggcctaagcataagcatggagtggaccccttcactccacacaagaatttccgtttgagcctcagaaaggattccctggtgtccaagactgacttcaaaccctggttgtgtgatttggggcaacctattaactctctgagcctaggttctttatctgtaaaatggaaagagtattagtaacaccgactacccagggaggctgtaagactcttcgccctttgccccaggtgtgctgttgatcaacttattgatctgcaaagtgggacaaatagcagtatctatcccatggaagctgtgaggatcccacgagatacgtgtatgtcacacactcagcccagtgcctggccccatagtggggatatattattgctgaggtgctttgtaaactcacagatgttatgtgaatgctagttttgtgtgtgtgtgtgtgtgtgtgtgtgtgtattagtgggcctggctcctctgccacttactatgagtctttggatgcatcgtctaacctctttaagcctacagattttatcatctgcagaagggataattatatcacacaggactgtcatgaaaactaagtgaagtcatatttgtactggacacttaagtgggagctgcataaaagtagctgctattactaaagcatgtaggaaactgtaaattgttgtataggtattatttcttgcctctttcttaagacttctatgaagagaaagtgagttagcatttgtgaaaacagcttgaaattctgtcagtattcacatgagaaggctgaaggtggtttgggctaatgaggtcatgtaaaaagtgctgtgaaatcatggtaatggaaaattctgttctatgagagtgatccttatgagcccttgggcaacagggttgagggtggggaggagattgactgtgttttcctctcattccttggctcagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggtaaggctctcctggggagcacggctctccccagcccaccacttcccagccagcctcccctggccctcagggtagtttggaatcttggcttcaaatggcacctctagatactacctctttcatccccttgactcagggtagatgttcagggagaaccagaggacagtgttccttcccagtcccttgatgcttttatttctcagagtggacaattgaataagagtaatccaaaagaaaaatgagcagaggatggagacagagaagcaaatgcaaatggcccttaagctatgaaaagacgtttaatctcagtcatattaagggaaagcaaagtataattatgatgaggtgagatttttcatatatcagattgcaaagactgaaagttaagataataataatataacaacaataataatgatatagtgttgtggagggtgtgaagaaacaggtagatataaccactatggaaagcaatttggagatatacttagaaatgcagctaacacttgcacatgtatgtgaggatatatttactatgatgtttactgcaccattgttagccatagcaacaacaacctatgtgtccttcagtagggaccaattaaattaattctggtacattcatataatgcaatgctttatggctaaataaggaggcagccctatatttactgaataaaatcatcttccacaaaaaattaagtgaaaaatgcaaggtgtagaacagcaaataaaatatgctttcaagccagatttggtggcttgcacctgtaatcctagctactcaggtggctgatatggtggcttgcacctgtaatcctagctactcaggaggctgaggtggggggatggcttgagcccaggagtttgaggctgcagtgagccactccactctaggactccagcccaagcgacagagggatgtaccatctcaaaaaaaaaaaaaaaaaaaaaaaaaaagactgggcacagtggctcacgcctgtaatcccagtactttgggaggccaaggcaggtggatcacctgaggtcaggagttcaagaccagcctggccaacatggtgaaaccctgtaactgctaaaaatacaaaaattagccaggcgtggtggtggacgcctgtaattccagctactcgagaggctaagacaggagaatctcttgaaactgggaggcagaggttgcagtgagctgagattgtgccactgcattccagcctgggtgacagagcaagactctgtctcaaaaaaaataaaaaaagaatatgcttccattctttattagatagattatctctagaagatacacacagaattatacctaggagatacagaaattagagatttaagtatctttagaaaatatactgttaataagtgctattcctccaggatgtagagaagtaggaactggatgactacaagaaaaattttccaagacatacttatatctttaaaatattatgcatgtatgacctattttttaaaatcttgaatcggaacatggcttcttcattagagagcaggcttagcatgcaaccctccccacacacaaatataaatcctcaataaggtaggaagaatttacataaaacaggccaggtgtggtggctcacgcctgtaatcccagcactttgggaggccgaggcggggggatcatgaggtcaggacttcaagaccagcctggccaagatggtgaaaccccatttctacaaaaaaaataaataaataaatacaaaaattagccagtcatggtggtgggtgcttgtcatcccagctactcgggaggctgaggtagagaattgcttgaacccaagaggcggaggatgcaatgagccgtgattgtgccactgtattacagcttgggtgacagagcgagaatccatctgaaagaaaaaaaaaaggatttatataaaacattattctctgagtagatcttgttgagaatatggggatggagtaacctggagggaacaggaagaagaggctgagtattccctcccagaaaatattcttaccttcatgactttaccaaagatacctttgcccttgggggcttctgacagatgagtatactgatagatgttgcttgcccacccaggagcccgacctgcccctgacctctgcttcgagaaggtgaatgtggcaggagacacctttggaaactgtggaaaggacatgaatggtgaacacaggaagtgcaacatgaggtgatgaccaaagggcaggcctcatgaaatgaggatgaacaagcagtttctgctctgtcctcactgttgcccaactcagcagtgtgactggccccagagctgcacctttacgtcaatcagttgaagtcagtcatctattctcggccccctgtttgacaatgcacttttcagctctgaggaagtcagaggagggtgtgggtggcagtgcttcctagaaagctgatcgggcttcctttggggaccatcttacagtagggcagggaatcagcccttttgggtcatttctgccaaattctaatcatgccctaatttgaatagctcctcattcattaattcactcattcattcatttattcatcattcattccaaccaaccatccactcatctgtctacccatccatccatccatccatccatccatctatccatccatctaccacccactcacccactgatccatccatctatccatcctccaccacccactcacccactcatccatccatccatccatccatctgtccgtccatctatccatctactatctattgaagatttactgtctatctactatctattgaagatttaccatgtgcaagatattgtgctgagtgcatggaacttctaattaacaatatagtatgacaatggcaatgtggagagagccatccaacccatcttagtgtgtcagagtggtttcccaaaggaagttatacctacactgagatctggagcagttacctcggtgaacagggtggaaggtggtgctggtgcataggagagtaatccaggaagagagatgaatagagaaaaactggtggttgaaagaactgagaacagtttgatacagttaaagtataatgttggggtgcaaaggagaaggtctgctgagaaattagcctggatagtttagcatggaccagatcatgaaaagcctcaaatgcatggctaggggagtttagattttagcttgagagcagtgtgaaaattagactcctatgaggcagactggaggcagggaaatcaatcttctgcagaccaggtaaggggggtggggcagtgtgaattaaggtagatagataataagatagataattaaggagggaagattgatagggtttgaaaatggcttgagcccaggagtgagggagaatggggagttggagatgaccccagatttctagctggaactcctgggtggacagcggtataaggggcaaaaagggaaagattgctcagctcaggtgcgctattcttggagttaaggacttttcgaggccagttctctggtctagatttgctcagggtcaaggagcctgttctcttcccttggtgtcagtccacatggaatctctcctggtgggttccaaagcacatgactgccctaaacctttgccccaccccacgcaagcctgctgtcttgatcaagaaagactgaagctctctggtgccccagctcttcctctgcctctgattccgcttccttccctctctgtctcttgtgcccagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatgtgagtcccctcccctgctcacctaggagccagctgcagagcagagtgattgagaagtgaggtctgagggaaggatgcctgggctcagatgccacctcgccaacctctgagccttggtggctcccttcatgaagcgtgtatagtgacagcaggcacccaccccagagaactgtcggaaggattaaagaaaatcatcccagtaaagcacttaggtggcctagctagtgccactttcatcctcatcgctaattatcataggaattaaaaatggactaggagttagggaagcctgagcaaaataatagcacagactctatcctccagagtcgattctgataatgaaactatggaaaacatgaagcatttagcatagcacctggcacagagtactgtcaccatcattatttttaaatataatgttaaaattgatacatattaatgacaagtaattaacataatcaacataatagtcctttaatgtgataacacataaataatattgtattgttaaatatgatactttaacaatatatttgtcgttttctccctaatcacaaaagtaatagcagaatttagttggctgttgtcctgtccttagcgttgtgggctgttttccatttttcactttgatagtaacctgaagtgtgctgcctatttgggccctcatactttttttcttttaagatggagtcttgctctgtcacccaggctggaatgcagtggtacaatctcggctcactgcaacctctgtctcccaggctcaagcaattctcctgcctcagcttcccgagtagctgggattacagacacaggccaccaggcccagctaatttttgtatttttcgtagagatggagtttcaccatgttggccaggctggtcttgaactcctgacctctggtgatccgcccacctcagcctcccaaagtgctgggattacaggcgtgagccaccaggccgggccatgggtcctcatatgttccaagtgcaaaatcttgcctcctaactcccaaccagcatccctcccattgcactgatcgttctgttttctctccgtgcagatttgctttgaggggcagtgcaggaacacctccttctttgaaactgaaggctgtgggaagaagtgcaatggccatggggtgcgtgctgggttctggcttctctgtgtcatggggacgtcatgagggcaggccctgtgggtggctgatgctctctggggtgctgatgcctctgccctttctttgctccaggtctgtaacaacaaccagaactgccactgcctgccgggctgggccccgcccttctgcaacacaccgggccacgggggcagtatcgacagtgggcctatgccccctgagagtgagtgccagcctgctggggccactgcccgcttttgtgagaagagcgggcatcaggggcaggtggcatgttgcagagcatccacattgaatcagcttcattgtcctgattttgtagagaggaaatcaggataaagacagaccaagagagaggagcgactgctcatagtgtggtgtggggacacggttcagtctctcttctcccatcctttctactgaggagggggagcccgcttagtagagtgagagtaagagagactgtaggtcattgaatgttcccattctttttaggggacacggtgactatttctctttgggcacttaaaaataatcatgaacctgggacacattatggtggtttagatttcctctgatggacacaagttaaaatggagaaccagacactcagaaaattttatagtattttagtggatctctcaaggattctagcactatgatttctaaagttttttttttaaaaaaaatagcaaataactttaaaaaaaaagcaccaaaatctttcaaggaagaaaccccaatatgtaaaactgataaaaagtagtgttttgttagtacaaatacgttctctatatttacattaaccacttgagagaatattggggtagttttgatgaaaccaaatgttaagttatggattatgggtgagatgtctagtcttaaatctgtctgagtcttttcgtttctttgttttttttttttttttgagacggagtcttgctctgtcacccaggctggagtgcagtggtgtgatctcgacttactgcaacctccgcctcccgggttcaagtgattctcctgcctcagcctcctgagtagctgagactacaggcatgtgccaccacacctagctaatttttgtgtttttagtagagacgaggtttcaccatgttggtcaggatggtcttgatctctttaccttgtgatctgctgaccgcggcctcccaaagtgctgggattacaggcatgagccactgtgcccggcccataatgtgtgtttttaattataatttgtaagttaaaataagtaatacaaattaaatgcaaatcaaatgcctgaagaagaagcacgaatacctattttgaaatctgctgtagccgagacagcttctaaatctcccacttgggttctgtttctggaaggtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcaggtatgacagggttcaatggaggactcagggtcaatttatgggtcacaaaggtctccataaatggtacttagcaaaagtgttggtgatagtgggtctaattcagggaagacaagtgcaagatacatgctgccctctcccctgctatgactgtgacaggcattactagttgatcttattgtaagtactctactgattctggtcatcactcctgagttcttctcagcagaatatccccaaccaaatcaagttgaaatataaaataaaatctatttgccatcctttgtctagttgatttattccccattttattttatttatttttgagatggagtttcactcttgttgcccaggctggaatgcagtggtgcaatcttggctcactgcagcctccgcctcctgagttcaagcgattctcctgcctcagcgtcctgagtagctggggctacaggtgcatgccaccatacccagctaattttttgtatttttagtagagacggggtttcaccatgttgaccaggctggtctcgaactcttgacctcaggtgatctgcccgctttggcctcccaaaatgctgggattacaagcatgagccaccatgcccagccccctctttgtctttttaaccactgttgctttaaagtttgtttcatctggtataagaatagctactcctgctcgcttttggtgtcccatttgaaaagtgatgtattattttggatatggaagatgtacagtctctgagtcacctattaaataacacttgttctggaggggattttaagtcccaggtctttctggatctatgcctgatggggattggttgatggctcgtgacacccttgtgtctcctcacaggggaagggtcttaaaagggtgaagagaaggtgctgagagagctctgctttgtataaggccaactctgtttccttgagagttctccattggccacacgtttttctacttaggaagatgtggttcgagaagaccaatcccactccctccagagcagacttgggaaagatttagctgcttgctggccgtgcttgggtcaaagggaactcaggcactgtcccctgctgaacatcgtcccctttcttttcctcccccatttcttgtttctagttgtcccttcagggtttctcagaacagcgggactggtcatgccaacccaactttcaagctgcagacgccccagggcaagcgaaaggtaagagctttgcaccactgaactttgctacttttcctttatccctcagggccatgctgtatttttctttttgagatggagtcttgccctgtcgcccaggctggagtacagtggcgccatctcagctcactgcaagctccgcctccagggttcacgccattctcctgcctcagcctcccaattagctgggactacaggtgcccaccaccatgcctggctaatttttgtatttttaatagagacggggtttcaccgtgttagccaggatggtctccatctcctgacctcgtgatccacccgcctcggcctcccaaaatgctgggattacaggcatgagccaccatgcccggccgccatgctgtgtttttctaagagcctctgtgggcccatgggattggtaataaaagcccttttattggctggagagacatgttatttggttctgacatcccctaatgactttaaaggttgcatctgacttctgggatcctcaggggtttaatagattggtgtgtctgttctccctttgggctctggtttatctcaaagagacacacaaggccagccctgagtgatttcttgtctcaggtgttccttgacttgtgcgtacaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggtaagtggataatcagcaaccttgggctgggaacattgcttttaaggccactttcaatgggtaatggcaaaggtggggaaggtgaaacttgtggggtcatgagctgactgccttttctgcaattcagtcaatacgggggcgcacagcaggttagagcaacgaacgtggggaaatagactctctaagaagctcctaaaccatgtggcattttctcccgggttggcctattttatgacaagccactacccaccttccaccccatattaacttctgtcagttcccccatgctcgtctgcctgctaggtctttgtaaatgctgcttgttctgcctgatacgctccttctctccttggtggggccacctcctgctcatcctcagatctgctcctagatgccgcttctcccaggaagtctatcctgattcctcaattctgaggttgatgggactgtacttctctcatcatagtactcttcctaccaaattgtacctattggtaccttctactgattggaaagtcttagggatgtatcctgatgccttgcccatcccaaggggcaggtgcctctgggaggtgagagtggggtctagactctcccccaccagccctggtgctcttggaggcatagcctgcccagcagcctgttcccactgcgtgtgtgtgctctgatggctctgaccacaccttctgcaggagatcccccagtgcagacacaggtgtttcctgggtggcggccgggtggggtgccttctggaactggcctgtgtgttttgggtgtgacccctcaactgagactgctttctctgggtgtaatccagagggctccatggaacccaagctgtctctgaccctaaggactctggggttggctgcaggctttggagggtccttgggatgtgtggcagtggtacagtttgggaaggctgagggcatccattctgtttctctgctgtgaaactgctgctctccccttccttttatgtggggcagaggtaggatggaaaaatccatgcagaaagagaggaaagattgacagggagagagaaggaaagaggaaaggaaaaaagcaagagaggggaggagtggagagagagaggtggagagtgtactcgtgtgctgagggtgctatagcagagtactgcacactgggtggcttcaaaacagacacttattttctcacagttctagaggctaagagtccaaggtcaaggtgctggaagggttgatttctgaagcctctctctgtggcttgcaggtggccgccctcttgctgtgttctcacgaggcctttcctatgcacttctgcctccctggtgtctgcctgtccaactctcctcttcttatgaggacaccagattggattaggtggcctcattctatcctaatcacctctttaaagaccttatctctaaatatggtcacattctgaggtactcagggttagggcttcagcatatgattttttttttttaaatgatgagtgcacagttcagtccctaacagagagatgaaagaaagggagaaagcaggcgtgtagagacttggggttacaggagaacaggagtgccagcagagggaggagggagtgggtcgggcgagcagtccactcagactgttgttctgaaaaacccacactagaggcatgttcagagaacacggggccagcctcacccctgtcacccctaggtgctgagccgtaggtcaggaa

SEQ ID NO: 8861 - DNA, 445 bp, Homo sapiens
ggcctcataggattgaagggacttgcccgacattgcacagttgtgagtggaggagctaggacttgaacccaggtctcatccagctgagtgagacagcctcctgccctggggccactcacagtctccagtctgccatcaaagattccccacctcctagctgggggacatggaccccctggagaagtgatagatgaaacctcatcacttcttcagttctgctattctaaaccggcttatgcacctgcactctgggccaggcaatgacgaggaaggcagatggcagctttgcctccaggagctcacattctgctggggcagtgactctgggatatgtgtcactgcaacagtgatatgtgctgtgaaggagaggctcagggtgctcagaagagagtaacgaggatttgacctaatctgggaaatccaggaaggtttccctgaggtggtg

SEQ ID NO: 8862 - DNA, 328 bp, Homo sapiens
gaattcttttttttttttttatactttaagttctaggatacatgtgcacaacgtgcaggtttgttacatatgtatacatgtgccatgttggtgtgctgcacccattaactcgtcatttacattaggtatatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggac

SEQ ID NO: 8863 - DNA, 4860 bp, Homo sapiens
  misc_feature (4173)..(4173): n equals a,t,g, or c
gagcagaggcagcatggccaggaatctatactcgagctactaagaggaaggaagtcgcagcaaaaatagcctgggtggggtggtagaaaatattaaggggaaaatgagatgactggggtggcgttgaagaagagctgcttaaagagaaacagggacacacgctgggtaaggaatcgcatgctgttgaaactgacggtgtggaaggaaagtgaggtggcggcggctgggctgtggtagaggaagccgatcaccagtgagtgaaaagggaactagggtacccacgcgtttgtgttttttatttaaactttggctaagttttgctaggagcgttttgcctttttttctcagaccttctactcctgtcgttctcccctaagttctgggcatgtggcttcttctctacctaccagggtagcctgtcattgctttaaaggacaaaatgaaatccctgatgggcaaaatatgtcccccctcttcccccagcttttggtcggctttgctcacccaccaacagctaggagctggaaggctcagaagagctggggtgggcatgggagagacagaggaaccccggtggctggaaacacagttccttcccagggtctcttcagcttgctggttggacctcttagcctgcttatgaagcctgaattgacatcatgccaactggtctcctgctgataagtgattccttaacttcctcgggagcagcagaaacttgttttgaaaaaaatcagattctaaatctttacagctgtttacttctgcaagcacaatggccgtagtaaggaattcaagtcacagcgcagcgtggcagggaaggctctgcatggagtcacaggacaaagcctgtcctggaaacgtgctggaaggaagtcggcctcattctttacgacgggcagcagctccaaatgagaaaccaaggggcttggctctgggtcagtagcatctgcctggcatgcggtgccagctgtggagaccagtgaggtggcagcagctgcactgggctcctggggtgtgcgtggggacctcaggggtttaggagctgatatacttttggttctcatcatcttgtgtgttccttgcagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattaggtaactttttaagggtgatcattcgagaataaagagttgagagaaggacacattttcaagctattgccctaccaggaaagaaatattacggaaaaatttcaggttaagatagcgactctactgcaatgaacaaatagcttatgtatattatttatttatttttagagacagggtcttgctctgtcagactggagtgcagtggcgcaaccatggctcagcacgacctcctgggctcaggtgatcctcctgtctcagcctcctgagtagctgggaccacaggtgtgcactaccccaagcaggctagtttttcatttttttgcagagaggttgtcttgctatgttgcccaggctggtcttgaactcaagccatcctcctgcctttgcctcacaaagtgctgctattacagacatgagccactgtattggactagtttatgtatggaatatggagggcccccagacctgcggcctctctgcacttgcggttcgagagggcagggtgtatagcaggactgccccctcctcccagtggccctgactggtggcggtgactgctgaggtcagcccaggtccacacgcacctccagggtctgcagtgtgaagcaggttgcagaaacgtgggtacctcggggcagttaccagaaaaggggctggagattaggaggaagccagccagtttagcagtcaccagtttagaagaggagacttaaccactttttaaattcaagaccccaccttctctaaacagcatagaaaaagctttctgaattatgatattaaacagatgtcttatgacgtttgcccgtttgtcttatgctgtttgttaatggtaaaaaaaaaaaaaaaaaaagcatcactgaaacactttattttaatggcatactttaatttgcagccattaggaggagacatcagaattaaagattgttgagcatcctaagtgcttttgatagttatcaaagggacatttagataaagtcagagctgggggtggtggcacacgcctatggtcctagctacttgggaggctaaggaaggaggattgcttgagccttggagattgaagctgcagtgagccatgattgcagccctgtactccagcctgggcgacagagcgagactgtgtctctacaaaagaagtgaaataagctgggggtggtggtgctcgcctatagtcccacctactctgaaggctgaggccacagtgaactgtgattgcattactgtactccaccctgggtgacagagaccccatccctttaaagagtttgggttaaagatcaccttctgcagtgaggtttacagtgatgtctgtcactacttgctatcatcttgtcattttctccattaacttcagtaaaaatttacgatcatacacccaaaccagaatgacgaaaagtaaaaagactggcagtaccaagtgctgtgaggtgccgtgcatcttgctggtaggagtgtccatgggtcatctggggcttgcaggctgcactgccacagccacctccttttctcatttcacctggggaaggctgttgggtagcacctgctagaatgaagagtgtgtatgcgctgcacagcagttctgctccctgggtgtataccatacagaagtggatattaatgtctctcagaagataggtacaagaatgttgtatctttattaccttataataaaatttggaaacaataaaaatgtccgtctacagagtgatgggcacataaagtctgtttacacaatggaacactacacagcattggaaagaaacgaactgattcacagacctgagcagggtctcagagacgcggtgctgagtgcaagaagccaggagagtatgacctgtactctctgattccaggatgtggagtcaagaccaggcggacctcctctgtggtggtggaggccagcgtaggggttatctggcgggtgcagtgggcgtgagggcgcccggtggaaaggttctgtgtctggatctggggggtggtggttggcggttaaacacgtggaaatttgacttacacacttgagatgtgtatactcgatgtaagttaccactcaaaacataaaggaaatacaaagtggcatgatgagaatgtcactgccccatatttgaaaacagctggttctagaagcagctggtgacacaggttgctctgacatgggatgttggcccctgggcactggcttggtgcacttgttcccctgtaggttttcaagcctttcacattcagcttcctggaaaggaaggtgcaatcctgccgtggttggcatcatgaagggctttacctggacacctctcacttttgtcatacctcttgctttttttccagacagacagtctagcagtgcttccttggagaccctgttagcacttcttcaggcagaaggggccaagattgaggaagacactgaggtaaagcccaccagccttggtggaatccttggggcgctttgggcagtccgtgggcccgctgcctccagggaccgtgagtgccacaccgccacggccaggagtggtgcctcccaggtgtacgggctgtataccagcaggcagcctggcctgtgtgctggggaaagtgccaggcaggggtccagggagcagcggggtgagtgagggcaggtccgagcgagggccaagagagggcatgcgtgccaccctgtgaacgccggcccctggggccagtggcggattaccacgtgccgtcgttcaagggccagctgggaggaggctacagagcttctgggacacgtccagctgcgcattagagccttgagcctcgccaggcgataaggaaatgagtcaaggtcgaatgttgtgcaggtggtgcaggctggggccggcagggtcttgccaagatagggctgggctcgatgaactctgaagccctgggggcacaggtgtttctgtcttgctnacccacccagggcgagtctgtcagtcagggtgcagccgggtggaagcaaggaggtgttggactccagcgggctcgagagaggcctgggacccaggagtcggagccctcacccaaaggccagctcctccccccgtcacgctggtggtggggtgcgcagcagggctgtcgtcctctccacctagtggcagctcatgctgaagcctgagcccatgacctctgggatctggagcaggagcgaggccctctgggtggttacagggagggggcagtgttggaagcagctggcgttgcctctccttgtgcctagaccacgaagggagcatcctccccatctggctgtccctgtaaccaggtttctgcctctttcagaacatggcagagaagtttctggatggagaacttcctctggattccttcattgatgtctatcagagcaaacggaaactggcccacatgcgacgggtgaaaatcgagaagctccaggagatggtcctaaaggggcagagactcccaccaggccctggccccgctgccccccaggctgcccgaactggcacctaccgccccccttccctaccctgccccagagccagtgggcctcctgccgttgcacctcggcgcatcccccccccaccacccccggtgctgcgggacgcttagccaccccgtttactgcggccatgagtt

SEQ ID NO: 8864 - DNA, 428 bp, Homo sapiens
gggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctggcgttgcatcggtttgcattatccgtgtgatttctaagta

SEQ ID NO: 8865 - DNA, 356 bp, Homo sapiens
agttacgtattcagctttattaaaaagtgcctgttttccagagtggccatacagtggtttttgtttgttcttttaaatgacttaacaatggaaggaaagacgcttctgcatggcctggcatagaaagcccatggagagccgccctgtgggtggggaagcgggtgacgggagccccactgcttaccagaaacccgagtgaaactgcgtctttccagtcccaagattctccttttttgctaaaggcatcagaagagatgaaagcatttctaccacccacatttcgaggacactcctagcttttactttagagttgggagagaggtttggttttcattgtcatttaaatcctgttgggt

SEQ ID NO: 8866 - DNA, 26210 bp, Homo sapiens
caggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacaggtatggcagaaatttggtttttatagtagaattctatatgtttcactgaataaatatgtgtttgtcattttcttatcctgttggtttaattggctaaaacaggaaaatgtgagctatcttttaaataaactgtcagctctgaacctgtcagctctcatcagcaagacaagataaagttcattttgctatagtttgatatttcacataggatgttctgttttttcttcttttttaaatttgagatataatttacacagcatagcattcacccttttaaaatgtccaactcactggtttttagtgtattcacaaatacttgcaaccatcaccactatgtaacttcagaacattcttctcaccctctgaaggaactttatacccattagcagccactctctgtttctcccatcctccagcccttggcaatcacaaatctttctatctgtatggttttgcctattctggatatttcttataaatagaatcatgtaatatatgatgtttgtgtctgctgtctttcagttagcatgtcttcagggtttatgcctgtcatagcataaatcagtacttcattccttttaaggccaaatcttgtgtgtgtgcgtgcgtgcgtgcatgcgtgtgtgtgtgtgagacagagtcctgctccgtcacccaggcttcagtccagtggcatgattatggctcactgcaacctctgcctcccgggttcaagtgattcttctgcctcagcctccctagtagctgggattacaggcacgcaccaccatgcccagctaatttttgtatttttattagagacggggtttcgccatgttggccaggctggtcttgaactcctgacctcagattatccgcttgcctcagcctcccaaagtgccgggattacaggcatgagccaccgcacctggcctggctaaattatattttgttatgtggatatgccatattttgtttacccattcatcagttgatggacaggacatttgtttttttctaactttttggctctgatgaataatgctgctgtgaacatttgtatacaagtttttgtatggatgttttgagttctcttgagtggaattaggtaggattgatggatcatatggtaactctatatttacctttattctcagaaactaccagactgtttccaaaatggctacaccactttatgttctcactagtaatttgcaagataactgctttctctacatcttcgccagcatgtgttattgcctgtggtttttgctgtagccatcttaatagcgtcaaatgttagtagttcagctttttagcataattagctgtaatatctaaccagtaaaaccattattataagcattctgtatagcaaatttagaaaaagctttttgacgtgaacacaatcctttccactacctactttttttcaactggaatgtattatactatacaaatctcctttcctccatgaaacttacaactccttgctgttgtactttttcaacttttatcacataccacttttatcaatacatttgtctttgtgtctcacaaactagattttaagctccttagagtcagatgtttcattttaactttacattttctcataatggtctgtctttataaagtaaatgcccagtgtttgttggataaatacatgagtagaaactcctttaatagagtaatgtgttcagttcatagttttaaagcactctcccttctagctttttgtgaacttacatcatatggtgctgtagcatatacacaatactggctgcatgctcagtgaacacatctatgctctgacccaccttcaagtgctgctaggcaggaagcttgccaggtacttctcaagatgaggaaactgggacacaacaaactttcattacttacacagatatccagttgtgattctcacctgttcatctcttaaccaggaccattgcagcagctctctccctgctgtcagtccctccatggccaccagggtcggccttatgttttcacaacacaagaacaggtagacttgagcatgattgaatgattggaaagcatccttggaggtggtttgaaggcattatctgagctgctcaaatatactgaaaaagaccttgtctggctgaagggactggctaaataaagttgttatggagactctgcaataacatgtaagaaagctcatgcataagcataacatgaaaaaaggatctgaaattgaagtggactatgattactatttagcaaaaatataaaatacaccagaaaagactgaaaggaaaactataagtggttgtgttacagcaataagattatagtggtcttttttttttcttttcctgccccctccccatcattgtctataatgtgcttatatgtatataagcacatgatatataaatataagcacattatatgtgtgtgtgtgtgtgtgtgtgtatgtgtatgtatgtgtgtgtgtgtgtgtgtgtgtgtatatatatataatttcttttttttttaatggaagaaaaatacagcctgggcacagtggcttactcctgtaatcccaacactttgggaggccaaggcgggaagatcacttgaagcccagaagtttgagaccaccctggacaagatgatgagacccccatcactgcaaaaaaattttaaaaattagccaggcatggtagcatgcacctgtcatcccaggtactcaggaggctgaggtaggaaggtcacttaagccaaggaggttgaggctacagtgagccatggttgcacgactgtactccagcctgggtgacagagtgagaccctatctctttaaaaaaaaacaaaaacaaaaaaaaagtgtacatgtgcagtccagacattttttttcccaatatttttgatccacagttggttcaatccatggatgtggaacccacggatatgtagggccaactgtatatctgtgttcttttataaatatgttgggaaagatcttgtacagcattgtctggtgtcagccacatttaaattttttagtagccacattttaaaaaagaaagaaaaaaccagtggcattaacttcagtaatatttttatttaacccattatatctaaaatatttcacgtatttttatattcaaaatacaaacattactcaagaaaaaatgtcttaaatattggactctcttctaccttctaagctttataagcctcacagttattagcacgatgctttgctctgctcacataggcatcctcagtcacttcagtcaaagaaaccctaaaaaacaatggtttgttccttttactctggtaggcctgataagtcatgctaggtagcatagcattcattgtctagcttggaaagcattgcttcctatgacatggcattgtgactacacatctgttcatagaaatataaataatcactaagagcttgcatctagggtctgataccctgggtttgaaccccatctttatcactcagtagccctgttcacagcaatataaataattgaaaagagcttggattctagggtctgctagcctggctttgaactccatctttatcactcagtagctctgtattcttgaccaatttacttagtaatctctccgtgcctcagttttctcatctgtaaaatgcagatttaatattagttccctaccttttaggattgctataagaatgaaataatgtaaagcactagaaatagaggacattggtagtctctgaataaatatcagttgctgatcaccttcataatttttcctccttagtagaagtttaataaacagtctaaaaaattccattatcttcggatttcaacttatcaaaacttttctgtcggtgtttttctgaaccaccacttcaggataccattgttttttgttcttgtactactgtatgcttgtcatagtcagaaaatatgtaatatttactgattaactaaattttaaaacttatctactctaaaggatgacatcaaggtgatacattttcattttaaggtttcatttatgttttgaataaaggcctattctctttgctaaaaccatttccagcctaggcaaattcgtgatttaacttaagggcaaagagaaggaatagttttcaggacatcatgggggaaatatagatagtcaagagaaaagatttctgtaccctcatttttctttccctgttctctaagctaccccctgatgccctaaggatgaaaagctagagctgctgggattggtacttttggaccgtgattaattgtctagtgaatcctgtcttgggagagcctatcctaaattcaccactgactttttctactcttacagcctaccttgtctagctcacaatatccagctcactctcctccttctagccttcctccttacctctctccatttaagcaagagctgtgctctgttctctttttttttttcttttttttttttaagacggaatctcgctttcttgccaggctggagtgcagtggcatcatcacggctcagtgcaacctctacctcccgggttaaagcaattctcctgcctcagcctcctgagtagctgggactacaggcatgcgcccgccaccatgcccagctgattttttgtatgtgtgtttttagtacagacggagtttcaccatgttggccaggaacctcgtgatccacccacctcagcctcccaaagtgctgggattacaggtgtgagccattgcgcccggcctctgttctctgtctcaagctttttacactttctaacatctgcttgctctgcctcaaatttttcaaatggacattttgtattttccatgtacttaatattttaggtagtatttaataactttacagatacatcattactcttgtataatgttccgggaatgtatctaagaagctccagtttccccagtctccccagcactgaagctttaacccagaagtatactgtaagatgttctttaaaaatattttttgtttgatttcatgaataaatctccttgtacattgttcactttattattgaactttctttatactttcatgtgctttagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcaggtaaaatctggttattgttctagaaagttcattttttttttcatttttaattttaatttttgtttattttttttgagatggagtctcactgttgcccaggctggagtgcactggcgcaatctcagctcactgcaactccgcctcgcagttttaagttattttaaaaataaccattatctttaggaaaaaagagctttcttaaaaatataaagtttgtacaatatcttccacactaaatacagttttgaaccatgaaattgagaaattagaaaaatcttagatctcagtaattaacacaagcgctcctagcatttgtatgtatttcctttgactttttttaatgccttgtgggatttttacataatcttagcttatatataattttgtatactttttaaaaattattaacattttcccaccttgaaacttagcctagtaaccattatcttgttacgtgcatagcaaattgtaatgagattttgggctaataataggattttacaacagaacttattataagccacagattaaaactggttatattattttctgtttcagtaatcttttgtcacaaatgacctcaaaactaaattatttacaacatcaacagtgactttatcctcttattgtttttatgggtcagaaattcaggaagagctcatttggatggttctggctctgtcccccaggattgccgtcagacaggtggttaagctgaaacagtaggagtccggagcggctggggaatgttaggacctctctctctctgttagagcttctccatgtggtctctccatgtgggctggtttgggcttcttcacagtatggcagcagcctcaggatgcttacatggtagctgaaggctccagtgtgagtcttctagctggctaaggttgccttttctgacctagctttaccttttgtaacctagctttgttatcatacaccatcatttccaccacattctcttgattacaggtgagtcataaaccctcctggattcaagtgggggataattagattccaactcttgatggggaagtggctattgttcagtatggctttctgtgataattggattgttctgtgtctacactgttcagtatagtagccactatttagcatttgatgtgtgcttagacgaaggaactgaattttataatttatatcattttaattgaaattgaaatttccacgtatgcacatggcagtctttatagatcagtgcaattctagaagaacgtggtataggagatgctgttgtggccatctttagaaaatacaatttatgatactgttctaaaaaatgtgttcgttatttcccaccacgaggaatgtctcctgccttaggagccagcttgcctctgtcctccttaactggaaagtcataaactggtagctcaagcaatatccagtctgaagatatatcttgttttgtccatatagtgatgatcatcattctcagtgaatatataaaagacacttttgaaacagttttttatgtactcagcatggccaggatggacaggactagagaattacaggccttgtaaatgatttcagactttcttggtaaaaatgtaattatatcgttcatctgtccagatgttacagactcagatgtcttcatagaaccaggagactgtggtgaacaggacaactcttagccaccaaaagggggcagtgactacccagccctagttagttgttatcacaggataatgtgctattggattttaattaataacatatccaggattaaatctaaactgcagtactggtctactgatttatatgctaatgttattgggattatttccttctaataattacctgttttacaattaatatagaaattaatttcctttagatatctacaactagattttgtgttgaaagaatggaaattgattttattccaagatacatttttcatttatagtaataacaatattatatcaaagtttgttaactttcccccaaatttgcaaaaactggggcatcatcctagactccttctctcacccattttgcctttttaaacattgccactggctaatgtgtatccctcattatttttggcctcaattactgcagttgccctcctgattattcgttgcctcccttcttgagttttcaaaacccaaagcacaaatctggtatgtcgttcctctttccttcttgagatgggattttgctctgttgcccaggctggggtgcagtggtgcaatctcggctcaccgcagcctcaacttgccaggctcaagtgatcttcctgcctcagtctcccaagaacctgggactgtaagtgtgtgccatcaagcctggctaatttcttttttaagtttctgtagagatagggtcttgctatgttgcccaggctggtcttgaactcctgtaattaagcagtccgcccaccttaccacccaaattgctgggattacaggtgtgagccacttcacccagcacccagcccctttgtgccattctatttggtaaaagtccctcagtgattccttattgcttttagaatagattccataatttagtatattgttactctccctctccagcagtctgttgccacaccccacacatgcttttccttttgcttcatatgacctttcacccccaccccatatcctgcgattcttgcatatttttgcaaagaacttcgaaacttgctctgaacttcttcaatctggttttaggctcctcacctttttttcctcataacacttgtataaatcaattattagagcactctgttaaaccactgttctgtgattatcaccttacttgtctgcccccaatgttagactgtagcttcttgaaatagtctttcctcgtttgtattgttgcactctttgcttgacttaactcttaagcttaacactagagacccaaatttagtttttgacttttatttataaatattttaactgtcagtaaagattataatagttcatggctttattcttttttaaagactttgcaaaaaataaaggcaaagtttacttttttaataatacagtacagttattgtatgggtcaattgaaccctgattatagaagtctagaaacatcatctttgtagtgtttcttttttagcttgaattgaacacagttgcaaattcagaatttttcattttccacccaagaagaaaaataagtgaagatattttgcagttattactcaaatcagaagataaacacaaagggacaaaaagcactgtagtcaaagtgataatggtgagattgattatataagcaaagtctcagaccctaggtaaattctcagacataataactagtgcatgaacaatatttttatttatttatttatttatttatttatttattttgagacaaggtctagctctgtcacccaggctggaatgcagtggcaagatcatggctcagtgcagtcttgacctcctgggcttaagtgatcctcccacctcagcctcctgagtagctgggactacaggcgtgtgccaccacgctcaacttatttttgtattgctttgtagagacagggtttttccatgttgctaggctagtcttgaactcctgggctcaagagatctacctgtttcagcttcccaaatgagccaggagccactgtgctctgctgaacaatatatttctagggatatatatatatatgagattattattcatgtaatcattcaacagaaagggcctagttatgtaacgtctatgataagaacctggaccatctcattttgctaaaaggacttgtaataatagtctttcatcttttattatttgtgcaccaaagtttccttatatggtccacaagtggtcaaatacacagttgtgtatataaggaaattggaaagagatgatgaagaaattttttaaaacctgttgaattgatcattctaatctttgtaataataaatatattgtccttataagtctgtatatgaaaatgtttcacaattatggagcaaagaagatgaccttcctctcaacaaaatcaagttgtcagtttaaaaaactgtattttgatgatgcaaaagaggaatcaaaagtaataagctagaacttaaaagagatgtaaatctggacttgtacattttgacagtgcaagtgcaagaagaaacagacgtagtgatgagctagtacctacctgttagagatgtacttgaaatctagaattgtatttcctagatggatatttttcagatttgtggatgacaattggtgagcagcagtttgttgcatttaaaggctcttgcccatcttggttatatacactttcagcctttggaaaatatgaattaaaatgtgagtcttctggccaggtgtagtgtctcacacctgtaatcccagcatttggggagaccgaggtgggaggactacttgagctcaggagttctagaccagcctggacaacatagcaagaccccatctctactataatataaaaactttaaaaaattaaaacataaaaataaaaaaatgtggttcttcttatgagtacattctaattaagatttctaataaaattgtttttcattatctttattctacagattatttgtaaaataactgaaaaataattaaaagagtcctttggccctagaaaataaatgacagtgatgatttttcctagcatactaaaggttaagaaattgttcttatttcacgaatgtgtgcattttgatatttggaatctttatgtgaaatccccattttacattgattatataatatattggtaattattaaagatctactatgtccttaaataaatcattgtcattcctcattgattactccttaaggtcaaataatatattttattaaaaactacacgttaagggcatatgtgtgtgcatgtgtgtctttatattctgacattttaaatttattcttttgttttgccattgtagtgctgatgagctccttctaactgagatgatgtttaatggccttttcaatgacctttctgcagaacaggcaacagcattattaagctgctttgtgtttcaagagaatgtaagttaattgattcagcacatcttatttattaattcacacatcatgtagttaatagtgttatggctatattatcaaatattactaatatttacatattataaggtaatgttaattggaaatcacagcaactttaacacaaatgtactaagaaaattaaatgattaaatacgtattattagaaaggagaataaaataagatttgttaacaatcaccattaattagattttaagttttaaatttgttctgtaacccaattcattgaacatttggccaagtcctagacagtcctagaaataaaaagatgagtgagaagaaaactaggaaagtctgataaaaataaaagggggaagtgaggttgaattaactctcctccccggtgttgaagaataatgacgaagcagtccatcctgctaggaactgaaacattagttttcatgggcacggtttgaggtagtgaatataagatccttgttggtttggcagcagtttttttcatatgagtaattagttcactttcaacagttcttaagaaatcaaaaaatgaagtgctggatggaacacataagaacactaattatccttgtactgcattccaaaaaccagtttgattcatttttaaaagtaagatatattgttttgcatttcaaatttaagactttatttattgtagatgaagtggatagaatgagaataagacaaggacatctgccttctaaaaataatttaatattctaaatttttggaggaccttttactatacatacttagtttaacttttaagtaaattgtgtagaacaaattgtttagtttttttttaagttccacagctcttaaatcttggggcaagatgtccgtatatgcagttaagatgtattcagtgaaaccacacttaattggtctgtttacctgttaactgtttccctatttattaatcagatcaaatatattacttcttgaagtagatgggtacttttctcaggtccctgattactgattagaatcacagctgttagtggcaatgataacaaataggacaataatccaaaaacagtttatgctttcctgggattgcctaccatgcatctatgaaatatgcatacaaaaggaatgcattactttacaaaatattgtgtttgtttttccttaggctcaaaattttattatatcaatttccaagataaagataattaagaacatttgtcaaacttacttggaataggaaggttcagagatgtaggtttgtaaatagtttggggataagtggtcttccacccatgtcaaattttgtcttacttttcattatttgcatgttcttgttgttttatattttggcactattacaatagttcctttttctgagaagccaattatattccctcttcaaaggagttggttaagctaaaccacagctcttaaatcttggggcaagatgtcaatatatacagttaagatttattcagtgaaaccacacttttttatatacagtgtcatcaattcttgtggtggcgccttttaacattgagatggaagattgtactgattgtcatgtggatttttcttgatgcttttaacagaatgttttctgccaaaaagaacattgtcttctagtaaatatagtaaaatacttgttataagtaagatgaaatttgcttgatataataacttctattttaaaatgtatttataaaactgtctctacattttaaaaataatatttaaaaggttatgtaaatctttataatataaagatcaagtgcatacaaaaatttattaagcacccaatgtgggcagtgtacagatctaagcaccagagatgcagcagaaatgtttgctttcctgatacttacatgttagtggatgaagataaagaaatacagtacacatacattctgtcaaataggggtgaaggtttttggagaaaagtgagaagaatcaaagatcactggggagatggtgttactattttaaataagatgattagaaaaggcctcactaatgacgtgaaacttatattgaggcctataggagtgatgagggaacaaactgtacatacctggtgggagaacattgttaaaatcacaattaacctcctcatatcaggactggtgccttccacctatagtgaatagcagagaggaatgtgatgagtagctgttgaccatgaatagacataatatcaaagacatttcgcagtcttgggttctttattaaactgagatgttaaggtcattctggctattttgcttttttgccattcatcaataatttttggttttagcagcaataatatggaatctggttcttgatttattatacatatatacatgttgcaaatcaaaatcaagtcctttataagtactggtgcttaaaataaaggcagatatgtcgcaactagcctacaattgctttaaaaaaaaaaaattagcgatcgggcacagtggctcatgcctgtaatcccagcactttaggaggctgaggcgggcagatcatgaggtcaggagtcgacaccagtctgaccaacatggtgaaaccccgtctctactaaaaatacaaaaattagctgggcgtggtggcactcctgtaatcccagctactcaggaggctgaggcaggggaatcgcttgaacccgggaggtggaggttgcagtgagccgagattgcaccattgcactccagctgggcaacagagcgagactctgtctcaaaaaaaaaaaaaaaaatagccataattactttaattaaaccctgtctcatacatacatacatatcattcttatagtaattttatttttgtacagtaactacctttgtcaaaaatttcttcacaaataatgtctgttattctcatcataagcctactcattttgaggatctggttttatttttctttgacagggcagaaaaccagtacacagaatttaagcagcttgtccaacttaatttggctacttagtgtacacctgaaactccattatctaattcagaaattgacagaattttcagctgtgggaaagcaatactaagaatactgaaactcagattaaacttttagctgtcttatactttgttagaacatctgggtaaaataaaaattagggacactatttttaacgtactttatcctgagttttcagtttcaaacttttcagtttctacagattgaaagttgcctagaaactaaaactgtttcaaagttaaactatgataaaaccctttaatgttgatgtaactaaactactgtgtatgtttacaatatttaccctccctcagttccatatgtaatcacaaaaaggagctagttagcacactttgcaaatttagcggtgtattttcctctgaaatgtaataacagaatattataatttgggatgagaggaatagtgattttgcctgtgtaaactgaattgattagaaactctaaatgctgatgactaaggtcttataatttgatatgtgactatcttacaagctttaatttgttaaaacaggtagtgtgaaaaaccagtaactttaaacgtgggtttttatatcttgttttccttttcttttatagtctagtgagatgcccaaattaacagaacaattagcaggaccacttcgtcaaatgcaggtaaggttttttttttttttttttgaactacatattttatgaatagtagattgtaaaataaacatttttgataatctaatcatagtagtttatcatttcacagagataacctataaggattaaatgttacttgatgtcagtcatgtaatttaatgttactctgataacatctcttgtgatttttactttaataattaaacagtatttcttcccattattgtaatgaactgtatagcattgttgtgaacagagattaaaagcttcataatgtaaataggctgtattgacagctcagtgcatgtgtcattttcttcctcagtactgataatggtatcttgaaggactaggatttagtttatttttaattttttgcacattttttcattctggtttataacaaagtttggttgttttattgttttgtttttgagacagagtctcgctctcttaccaaggcctggagtgcagtggcgtgatctgggctcactgcaacctccaccttccacgttcaaatgattctcctgcctcagcctcctgagtagctgggattacaggcgcccgccaccacactcagctaatttttgtatttttagtagagacgaggtttcaccatgttggccaggctggtctcgaactcctgagctcatgtgatcctcccacctcggcctcccaaagtgctgggattacagatgtgagccactgtgcccagcctataacaaagttttaaaatctgttttatcataagaaattgtctctggatcctcaaagccacagtagtttatagtaataaatttctctcttactattttcataggataagccgattttttctgtctgttcaacattagacaaagacaaggaaagatgagctaaggaattacaagagaggaacaaaaaaatgtgtcataaaagggccccttcagaacaacagacactggtgcctacttgagggaggagagtgggaggaaggagaggttgaggaagaaaaaagaaaaaaaaaacctgtggcatattatacttagtactcagctgactaaataatctatataccaaacccctgagtcacaagtttacctagataagaaacctgtacatgaacccctgagcctaaaataaaagttaaaatatttttaaaataataattcaaaaaattctgattaaaattaaaaggccagttcagtggaacatgtaacatgccttaaaatcactaagaaatttaaatttctagaaccagcaaagtcttcataggcctaggagtttttggccttttagattgccaagtaaagaagaatgaagcttctcaacttagaggaaaacaatatgaagatatgtacatttttaagcattgttgtggaaaaatgtattttgctctaggatttgtatttctctaaatctgttttgtaatgaaataattagagattagttaaatgctgctcttgaataattttaatgaagagttctgtttctttgttgaaaaggtatcactggctgaaaagcatgctcttgatacatttttcttagttaactacctcaacataatgggaaagattggccgtttaatcacttagcaatggaacaggcactgtgcctacttaggagcagaatgtccacattgcagacataatacctaggaagaaaaagggacctcctggaatactggcttggaaacctaaagaataaagtgatatgggagatcataagtaaggaattttaactcttttatctttaaaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggtatggttaaattttacacatatatatttacagtataagaaatacagttaggatggtattgttttaattaaacaagtataatatgtatttttaatatttggtaactaaatgaaatcttctccctattatatagattaaaaaatattctccacaaattctttgtattatttaataagcatagtctgttcattagaaagtcctttagaaactattttaaactgtataattctgtgcagttgtaattctatgagtttctacagtcacaagcagatgaccctaagaagtcatatttatgtgggtatttttccttttcacttttgttctcctggtgagctatataattccactaaaaatagcagagctgaaaatgatcagtcattgcatatgtaattgacttggctttagtcagactgttattgcagcatgaatcagattaaatttaatgagcaggattttaagagactgaagaataattgttactcaactgaagagaaattttaaatgaaaaaattaaggcaaaagaaatataaggactaagtgaataataagaagcaaaaaaataagtagactgtttaaacgaaaccatattttaaaatgctgcattcagtaggaaaagattggcttgtgtgtttataaatggccagttgtatttactgaatgagataatttacattgaactttcctaaaaatgaaaataaatgagtttgttctgtatagagattataataagaactgctactattgcttataggtttagtttgagaaaaattacatgtttaacatgccaaatattataggcctttcaactgatattattaaagaagtaatagattactgattttatgaatcagttatttttatgatgcataggttaaacttctctgcaacagaatattaaaaacttaaactgagggcctttactacattgaactttatgggttttaaggtttttaatgttaaagtttatagcacatttttaaattatggtgttgtatcttacatattttttctaaggtttataaacttctcagcctcctctaaatgatcatttagtcaaacagtcccaaagcatcctttgaattctgtattctgttactgggaaagtcattgcccagtaagtactatatgccgaacactgtgctaagagctctgtataatttacatgtaatcaccaaatagcaattcagggtagatattatctccactttgcacaaggagactatggtaaacagtttggccaaggtgatgtgagggcacgatgatttaaactctggtctctgtaactacatgtaagttcagttaagcaccataccaccttatccttaaattttggatcacctgaaaatttcttaaaccctacactagactataccatctccatccacagaaaagtcatgcttggagtaatactaaacaggtcttaatcctagatgatgtttagcaacatctctaattagttaatggtgtttagccgagtcagtgagaagagggatgttgcgtactcactgatgaaaattgcttaaaacaggagcacaggttggtgtatgacaattgtgtttcagcagcactagggcgatcacatagagcaccaccagtcttcagtctgacatctttttggaacataaggatgaaactagtaactgttcaatgcctaataataagacttgataatacaatactcatatttgtataatatctgcttctctgaaaagtcagaacacaatgacataaaacaatagtggtacatggcagagagtagcttttttttatttttttatttttatttttattttttattttttttagaaaagtaaaaagcaggccaggcacggtggcttacgccggtaatcccaacactttgggaggccgaggcgggcggatcaggaggtcaggaaatcgagaccatcctggctaacacggtgaaaccccgtctctacaaaaaatacaaaaaattagctgggtgtggtggcaggagcctgtagtcccagctactcgggaggctgaggcaggagaatggcgtgaacctgggaggcagagcttgcagtgagctgagattgtgccactgcactccagcctgggtgacagagcgagacaccatctcaaaaaaaaaaaaaagaaaaaaagaaaagtaaaaagcaagggcagtagacctggcctgtcagatgagtatatttttttttaaatctaggaattcatataaaattgtctttatggattattttttctgttctttctacctaagtagaagttatcacagtatggaagataaatcctaaactgccaaattgaagatggtttgtagctcatactagatgccacctatgagttgactttttccacagcataccagcattcctgaagtctgttctgtcctctttcagttactcaggggctatttctacatcacagtttgcttgaaatttcagtttgaaaatttgagaaattcagttttttagctctaacttgaaattagatctaacatctgcataatttttatgtttttctggtgtgtgagccagtagatgagcttaaacctttctaaaaattgggatatactatgtattcgcccttaaaactattttttgatttaagtagcaaaaaatgagaaccttcattttcttaggatagtatttctctcttttgtttttacagtgttacatagtgcttccatttcaagaatagccattccttcctcatctcgttattgtatatggttgttttttattttttgcaacagggtctggctctgtcacccaggctggagtgcagtggcgtgatcttggctcactgcaccctccatctcccgggcttaagtgatccttccacctcagcctccagagtagctgggaccacaagcatgtaccaccatgcccagctaatttttgttaatttttgtagagatatgattttaccatgaagcctaggctggtctcaaactcctgggctcaagtgatccacctgcttcagcctcccaaggtgttgagattacaggcatgagccactgcagctggcctacacatgttttatgattggaaaaatactgtaatcaaagctgtagcacacagtacagtgtgtctgtttttacaggcagacaataattgcattggaactttctaatgtgctgtgtgcaaaccatatttgttcctaataagattcttaattttcttttcatatgaaaataaaagtgtctggtcatttcatatcctgagcctcagaagtagttttaagtattcttcaaacattaactgaggctagttaacactgtaatgattaaaaccatgtgtttgggggatgtgtaatgcaaaagaaaagttcatattgtgattcagttgagaaattttgaagactaagtatttattctgttatcaccctggaaaaaaaatgacagaatttagctgttttttatttccattaaactaaatttgaatgacagtttaaacaaactatttgtatgggctgatgcctagggttttagtcaagtaatccagaggctgttactatttatttctgactctacataaacaatattgtactcttaactatgaaggatgacaaaggatttgctttccactgagcaagtgtcattaggaaagcttctatgatgaattatctcttgaaactatttactgtacctctgcctgccatatgctttttattttttttcagtcctgctccctctgtatgccacatgttttgaaagcaaatactgtgaattgcattcctcaactctgtccccaccacacacattctctcacatgcctttcaagtagcagtttaaccctttcttagcatcatcagtgtcatgagtggttttccagtggatttgtcttttaaaagtattctcgctgataataatagagtaacaatttattagtaattgtttctgtctttacattttggcacagttttagtacctgatacttactcgtttaatgaataattctgagaccctagtgggaatcaggcaccatgctagttacagtgtgagcaatagtctctgctctcaagaaagggttcagcctaagctggggtttagcggcaagtagttgcaagatacatgtgtgattctaacctgaggccaggctggataggagtattaaattcgggtcagagcatgaactgtaggaaactgctttagggtatgccagaaagctgaaggcagaagttctgttcgggaaaatctgctgctttctctccttaatgagaatgatgctgttttgttcatcaaccgggtaaggctgatgtttattaaaatgctcttaaataaaagcatatagtcccaagtgtccatcgatagatgaataaattgtggtatatattaggttggtgccaaagtaattgtggtttttgccatttttaatggcaaggtgttccattgtaataaagattaaatggaacagctttcagttagaaaagacatactgactcatgctacaatatggacaaaccttaaacacattaagttgaaagaaggcagacacaaaggccacatagtgtataatttcacttatatgaaatgtccagagtaagcagattcatagagacaaagcatagacgtggttgccatgggctggagggacaggaagacatgtaactgcttaatgggaacaaggttttttgggggtggtaaaaatgctctaaaattagataatgatgatggttacacaagtctgaatatactaaaaaccactcagttgtacacttatttaaaataattttatggtgtgtgaattctgtctccatgtgagttcttccagaatgtagtaaacctgaatataaaaaagggcagtaactgacttgtatactttaacatggttaaaaaggtggattttatgttttatattttaccactatttgaaaaattttttaaagacaataactagaaagaattggatttctctttctactctggcaggaccaaaaaaaaaattttgtaacaaaccagtaggttaatgtggttttgttttgcttcggttttggtcagcttcatttagcctatgatgggtcatggctttgaaacttttgtctagcacttagtcaggctgatgaggcaggatgacttataaaggtgggtgtaagaagagcccttggattacagagaactgtagtaggtaggagagatgctagacaattcactacttaatcgtcagtcttcattaatccctggggggagtagcctctatgtttcaggcagctctggacagttagtgtttgtgcacatacccagtgatttgttgatgagactctgtgggcaacaaccacagtcattgtatatgcaaccttgtgcctactggcctaatttgcttgttacctgaaactgtgtcgaaactaaagtttccagaaattgagtcgaaatgtttacaaaatgtgacatgacagtgctctctggcctgaatgtgcatttacttgccttagtttattctttatcttagtaatttacttcgtatggtttggtctctgataactttcacagattctggttaacacgagttactaaaatttgtgaaataatagtatcacattgtgtttcttggtacacatttgaagtcagtcaaaacaatgtttgagaatgtgtctggctctttaatgccctatgcagcagaggactttgtaaaggatttcatttcaatcctaaatgacctgtgagaatctggtctcaggtaaaaatctagttacattttgagccactacctaatttaattatctttggatatacttgtttgcataaacatttaatatctgattgcataggtaatatgacattaccctctctatcccaattcctaccctctctcttgacacccagaagtttctgcagttggatttcctgtttcattgcaaggcagtattggagcctgcattcctagcagctgagaatagaaataacaaataattattattaatttaataattgttaatagtgtaaatagttcattgttcctacagactgcattttgagaactggtattcctaatgtatttcatatattaaaaatgaagtcaagcgttttagatttaggcaggtagcacttagagaaaggatctcacaatctctgctcctctttggacaagtctagcaaaagtgaaactatgtttatagcttcagctttgatacaaacacttttctcaaacagattctagacccatgggaaaaggcttctttccttgtgctccttgagaacactgtgtaaagaacgtactaatgaaagaatctaaggtcaagaagaatgaatgcacctttaaaatgacaagttttatcttgttactctcctgctaaaaacagtctgttgcattctatgagatggtatggatggtgtccagatgcctcactaggccacactcagggtccttgaatagctgcagtttgccaggcttttctgcattgtcgtggtggtccttcccttgttgctgctgcctgagagatactgcctggttcttacagacacagattatgtcatccttgcagccttcacccaaagttgctccctccttctagggcattttgttttcctacttaataccaagtgtcagcatgttagtaataaacaggtgtctctaccattagtcaaaggtgggagttaagcctttcatctttgtagctttctccagtacctaaccatgatttacttcatgggaagtccctcaaagtactattaattatcctgtgttctcctgccttgcctcttaacaaaaattctgctgttcctgattatttccattttaccagtgttttgttccttttctatccaggcagcataattcgttgtatgaggcgcctggaagaattgcttcgacaaatgtgtcaagcagcaaaagccattggaaacactgagctggaaaataaatttgcagaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatttatcagatggtgataagtctgtaagataaaaacaaagcagaaaagacaatagaattggcagatggatatgatggtctagggcctccacagggaaggtggcagttaaggcctttggtgtatgcttgatgtacgtgaacaccagcaagaggccagtgtggctggagcagaatgggcagtgagtagaggagtaggggttgaagtgagaaaggaaatgattccatagttcccagccccaggcttctcaactctgcagtgactggaggtgtggagtttgggagtgacctgccccaacttggactttacaaggtaattgttgctcttacattcagggcaagtctgtagagtagcacagtagaagtggggagaacagatcaagaaaggatggctaaaccaaggtggtagtaatggagtggtggtgggggggcaaggggcataagcttcagtcctgtctactgactcttgaccaagaaaaaggactaagttaatcaaagaatataaccacattgttgctgagtcagtcaatgctagtgatttctgcaaacaacttagtgtcctaagaagaggtttgcaaaaactggctgatatttccacagttgataaatgtaggcctgtttaatgactcagaatttaagtgtaggtgtcaaagttttaaaaataatttgtaatcaaaatttgtatttgtccttccttggcctagaaagaatttcacatgggaactgaaaaaaaagtgtcttctgatataggttgaaaatccaagtctttggattttacatttctttagacagtttagtccttccctataattttttttatttttatttttatttatttatttagtgtgtggagacagagtttcgctcttgttgccccaggctggagtgcaatggcgcaatctcggctcactgcaacctccacatccacctcccaggttcaagcgattctcctgcctcagcctcctgagtagctgaactacaggcatgcgccaccacgcccggctgattttgtatttctagtagagacggggtttctccatgttggtcgggctgctcttgaactcctgacctcaggtgatccgctcgcctcggcctcccagagtgctgggattacaggcatgagctactgcgcccgacctagcatttatctttttaaacagttctagacacctctttcctggccagcccccatggagtatttcagagtcaaaagaacaggggtctggcttgtatgttttccacctcacagaggtggctgcaaattcctctaggtgttcagcaaggtgtttgactttctaggctgctcgcttaccagttgaatcagggttggtatactggctttaaaatttcggtagaggcaagttaggtgttttgtggtcttgaaagtttaaaccttactttcttttctcttaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttctacatgtgaattagttttttcaagtcataatcccctaaaaaaactatttctagccagagcctttcacaataaaaatactaagattttacaaaaatactaagttttagaaagagcaacctagtttttaacctggtgtgtatcctgaagtgacttttaataacattgagattcttgcccactgcatagtcttctcctcagctggggattttttggatttttttttttctatttacttatctaaatgtttagcaatatcaagatgtaggctgttgacctgtatacttacaactaatattgcaaccagagctccctgaatgagtccagtcaacacatcgctccagtggtgtttataatcagaaactcgagaaaggcccacataaatggatacggcaacaagaccaaattgcagtgtggggcgtaagagtcttgcccagtctcccttcatcctggcttgaagataaagctaaaagaaaagaataaagaaaaaaatagtttatttaacataacgcaaaacttttatattaaggaagggttggcatttgaaatgattatcaaagtattattatatagggaacaggacttctaggcaaacattcacgtacgcattattacctaaatgttaatcctttaaagaaacaaaactattgccctactaacttgttcacaagaatctattgccagtctagctataccacccttcaaactgtatacaaacaggtgtttccttgtttatggctttctaaacaggatttcagggacagttcctccccttgcaatttgggttataattctcatagtcaagaccagtgctgccattggtttttttattgttttccttaaagaaatggggtgttg

SEQ ID NO: 8867 - DNA, 26197 bp, Homo sapiens
caggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacaggtatggcagaaatttggtttttatagtagaattctatatgtttcactgaataaatatgtgtttgtcattttcttatcctgttggtttaattggctaaaacaggaaaatgtgagctatcttttaaataaactgtcagctctgaacctgtcagctctcatcagcaagacaagataaagttcattttgctatagtttgatatttcacataggatgttctgttttttcttcttttttaaatttgagatataatttacacagcatagcattcacccttttaaaatgtccaactcactggtttttagtgtattcacagatacttgcaaccatcaccactatgtaacttcagaacattcttctcaccctctgaaggaactttatacccattagcagccactctctgtttctcccatcctccagcccttggcaatcacaaatctttctatctgtatggttttgcctattctggatatttcttataaatagaatcatgtaatatatgatgtttgtgtctgctgtctttcagttagcatgtcttcagggtttatgcctgtcatagcataaatcagtacttcattccttttaaggccaaatcttgtgtgtgtgcgtgcgtccgtgcatgcgtgtgtgtgtgtgagacagagtcctgctccgtcacccaggcttcagtccagtggcatgattatggctcactgcaacctctgcctcccgggttcaagtgattcttctgcctcagcctccctagtagctgggattacaggcacgcaccaccatgcccagctaatttttgtatttttattagagacggggtttcgccatgttggccaggctggtcttgaactcctgacctcatattatccacttgcctcagcctcccaaagtgccgggattacaggcatgagccaccgcacctggcctggctaaattatattttgttatgtggatatgccatattttgtttacccattcatcagttgatggacaggacatttgtttttttctaactttttggctctgatgaataatgctgctgtgaacatttgtatacaagtttttgtatggatgttttgagttctcttgagtggaattaggtaggattgatggatcatatggtaactctatatttacctttattctcagaaactaccagactgtttccaaaatggctacaccactttatgttctcactagcaatttgcaagataactgctttctctacatcttcgccagcatgtgttattgtctgtggtttttgctgtagccatcttaatagcgtcaaatgttagtagttcagctttttagcataattagctgtaatatctaaccagtaaaaccattattataagcattctgtatagcaaatttagaaaaagctttttgacgtgaacacaatcctttccactacctactttttttcaactggaatgtattatactatacaaatctcctttcctccatgaaacttacaactccttgctgttgtactttttcaacttttatcacataccacttttatcaatacatttgtctttgtgtctcacaaactagattttaagctccttagagtcagatgtttcattttaactttacattttctcataatggtctgtctttataaagtaaatgcccagtgtttattggataaatacatgagtagaaactcctttaatagagtaatgtgttcagttcatagttttaaagcactctcccttctagctttttgtgaacttacatcatatggtgctgtagcatatacacaatactggctgcatgctcagtgaacacatctatgctctgacccaccttcaagtgctgctaggcaggaagcttgccaggtacttctcaagatgaggaaactgggacacaacaaactttcattacttacacagatatccagttgtgattctcacctgttcatctcttaaccaggaccattgcagcagctctctccctgctgtcagtccctccatggccaccagggtcggccttatgttttcacaacacaagaacaggtagacttgagcgtgattgaatgattggaaagcatccttggaggtggtttgaaggcattatctgagctgctcaaatatactgaaaaagaccttgtctggctgaagggactggctaaataaagttgttatggagactctgcaataacatgtaagaaagctcatgcataagcataacatgaaaaaaggatctgaaattgaagtggactatgattactatttagcaaaaatataaaatacaccagaaaagactgaaaggaaaactttaagtggttgtgttacagcaataagattatagtggtcttttttttttcttttcctgccccctccccatcattgtctataatgtgcttatatgtatataagcacatgatatataaatataagcacattatatgtgtgtgtgtgtgtgtgtatgtgtatgtatgtgtgtgtgtgtgtgtgtgtatatatataatttcttttttttttaatggaagaaaaatacagcctgggcacagtggcttactcctgtaatcccaacactttgggaggccaaggcgggaagatcacttgaagcccagaagtttgagaccaccctggacaagatgatgagacccccatcactgcaaaaaaattttaaaaattagccaggcatggtagcatgcacctgtcatcccaggtactcaggaggctgaggtaggaaggtcacttaagccaaggaggttgaggctacagtgagccatggttgcacgactgtactccagcctgggtgacagagtgagaccctatctctttaaaaaaaaacaaaaacaaaaaaaaagtgtacatgtgcagtccagacattttttttcccaatatttttgatccacagttggttcaatccatggatgtggaacccacggatatgtagggccaactgtatatctgtgttcttttataaatatgttgggaaagatcttgtacagcattgtctggtgtcagccacatttaaattttttagtagccacattttaaaaaagaaagaaaaaaccagtggcattaacttcagtaatatttttatttaacccattatatctaaaatatttcacgtatttttatattcaaaatacaaacattactcaagaaaaaatgtcttaaatattggactctcttctaccttctaagctttataagcctcacagttattagcacgatgctttgctctgctcacataggcatcctcagtcacttcagtcaaagaaaccctaaaaaacaatggtttgttccttttactctggtaggcctgataagtcatgctaggtagcatagcattcattgtctagcttggaaagcattgcttcctatgacatggcattgtgactacacatctgttcatagaaatataaataatcactaagagcttgcatctagggtctgataccctgggtttgaaccccatctttatcactcagtagccctgttcacagcaatataaataattgaaaagagcttggattctagggtctgctagcctggctttgaactccatctttatcactcagtagctctgtattcttgaccaatttacttagtaatctctccgtgcctcagttttctcatctgtaaaatgcagatttaatattagttccctaccttttaggattgctataagaatgaaataatgtaaagcactagaaatagaggacattggtagtctctgaataaatatcagttgctgatcaccttcataatttttcctccttagtagaagtttaataaacagtctaaaaaattccattatcttcggatttcaacttatcaaaacttttctgtcggtgtttttctgaaccaccacttcaggataccattgttttttgttcttgtactactgtatgcttgtcatagtcagaaaatatgtaatatttactgattaactaaattttaaaacttatctactctaaaggatgacatcaaggtgatacattttcattttaaggtttcatttatgttttgaataaaggcctattctctttgctaaaaccatttccagcctaggcaaattcgtgatttaacttaagggcaaagagaaggaatagttttcaggacatcatgggggaaatatagatagtcaagagaaaagatttctgtaccctcatttttctttccctgttctctaagctaccccctgatgccctaaggatgaaaagctagagctgctgggattggtacttttggaccgtgattaattgtctagtgaatcctgtcttgggagagcctatcctaaattcaccactgactttttctactcttacagcctaccttgtctagctcacaatatccagctcactctcctccttctagccttcctccttacctctctccatttaagcaagagctgtgctctgttctcttttttttttttcttttttttttttaagacggaatctcgctttcttgccaggctggagtgcagtggcatcatcacggctcagtgcaacctctacctcccgggttaaagcaattctcctgcctcagcctcctgagtagctgggactacaggcatgcgcccgccaccatgcccagctgattttttgtatgtgtgtttttagtacagacggagtttcaccatgttggccaggaacctcgtgatccacccacctcagcctcccaaagtgctgggattacaggtgtgagccattgcgcccggcctctgttctctgtctcaagctttttacactttctaacatctgcttgctctgcctcaaatttttcaaatggacattttgtattttccatgtacttaatattttaggtagtatttaataactttacagatacatcattactcttgtgtaatgttccgggaatgtatctaagaagctccagtttccccagtctccccagcactgaagctttaacccagaagtatactgtaagatgttctttaaaaatattttttgtttgatttcatgaataaatctccttgtacattgttcactttattattgaactttctttatactttcatgtgctttagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcaggtaaaatctggttattgttctagaaagttcattttttttttcatttttaattttaatttttgtttattttttttgagatggagtctcactgttgcccaggctggagtgcactggcgcaatctcagctcactgcaactccgcctcgcagttttaagtgattttaaaaataaccattatctttaggaaaaaagagctttcttaaaaatataaagtttgtacaatatcttccacactaaatacagttttgaaccatgaaattgagaaattagaaaaatcttagatctcagtaattaacacaagcgctcctagcatttgtatgtatttcctttgactttttttaatgccttgtgggatttttacataatcttagcttatatataattttgtatactttttaaaaattattaacattttcccaccttgaaacttagcctagtaaccattatcttgttacgtgcatagcaaattgtaatgagattttgggctaataataggattttacaacagaacttattataagccacagattaaaactggttatattattttctgtttcagtaatcttttgtcacaaatgacctcaaaactaaattatttacaacatcaacagtgactttatcctcttattgtttttatgggtcagaaattcaggaagagctcatttggatggttctggctctgtcccccaggattgccgtcagacaggtggttaagctgaaacagtaggagtccggagcggctggggaatgttaggacctctctctctctgttagagcttctccatgtggtctctccatgtgggctggtttgggcttcttcacagtatggcagcagcctcaggatgcttacatggtagctgaaggctccagtgtgagtcttctagctggctaaggttgccttttctgacctagctttaccttttgtaacctagctttgttatcatacaccatcatttccaccacattctcttgattacaggtgagtcataaaccctcctggattcaagtgggggataattagattccaactcttgatggggaagtggctattgttcagtatggctttctgtgataattggattgttctgtgtctacactgttcagtatagtagccactatttagcatttgatgtgtgcttagacaaaggaactgaattttataatttatatcattttaattgaaattgaaatttccacgtatgcacatggcagtctttatagatcagtgcaattctagaagaatgtggtataggagatgctgttgtggccatctttagaaaatacaatttatgatactgttctaaaaaatgtgttcgttatttcccaccacgaggaatgtctcctgccttaggagccagcttgcctctgtcctccttaactggaaagtcataaactggtagctcaagcaatatccagtctgaagatatatcttgttttgtccatatagtgatgatcataattctcagtgaatatataaaagacacttttgaaacagttttttatgtactcagcatggccaggatggacaggactagagaattacaggccttgtaaatgatttcagactttcttggtaaaaatgtaattatatcgttcatctgtccagatgttacagactcagatgtcttcatagaaccaggagactgtggtgaacaggacaactcttagccaccaaaagggggcagtgactacccagccctagttagttgttatcacaggataatgtgctattggattttaattaataacatatccaggattaaatctaaactgcagtactggtctactgatttatatgctaatgttattgggattatttccttctaataattacctgttttacaattaatatagaaattaatttcctttagatatctacaactagattttgtgttgaaagaatggaaattgattttattccaagatacatttttcatttatagtaataacaatattatatcaaagtttgttaactttcccccaaatttgcaaaaactggggcatcatcctagactccttctctcacccattttgcctttttaaacattgccactggctaatgtgtatccctcattatttttggcctcaattactgcagttgccctcctgattattcgttgcctcccttcttgagttttcaaaacccaaagcacaaatctggtatgtcgttcctctttccttcttgagatgggattttgctctgttgcccaggctggggtgcagtggtgcaatctcggctcaccgcagcctcaacttgccaggctcaagtgatcttcctgcctcagtctcccaagaacctgggactgtaagtgtgtgccatcaagcctggctaatttcttttttaagtttctgtagagatagggtcttgctatgttgcccaggctggtcttgaactcctgtaattaagcagtccgcccaccttaccacccaaattgctgggattacaggtgtgagccacttcacccagcacccagcccctttgtgccattctatttggtaaaagtccctcagtgattccttattgcttttagaatagattccataatttagtatattgttactctccctctccagcagtctgttgccacaccccacacatgcttttccttttgcttcatatgacctttcacccccaccccatatcctgcgattcttgcatatttttgcaaagaacttcgaaacttgctctgaacttcttcaatctggttttaggctcctcacctttttttcctcataacacttgtataaatcaattattagagcactctgttaaaccactgttctgtgattatcaccttacttgtctgcccccaatgttagactgtagcttcttgaaatagtctttcctcgtttgtattgttgcactctttgcttgacttaactcttaagcttaacactagagacccaaatttagtttttgacttttatttataaatattttaactgttagtaaagattataatagttcatggctttattcttttttaaagactttgcaaaaaataaaggcaaagtttacttttttaataatacagtacagttattgtatgggtcaattgaaccctgattatagaagtctagaaacatcatctttgtagtgtttcttttttagcttgaattgaacacagttgcaaattcagaatttttcattttccacccaagaagaaaaataagtgaagatattttgcagttattactcaaatcagaagataaacacaaagggacaaaaagcactgtagtcaaagtgataatggtgagattgattatataagcaaagtctcagaccctaagtaaattctcagacataataactagtgcatgaacaatatttttatttatttatttatttatttatttatttatttatttatttatttattttgagacaaggtctagctctgtcacccaggctggaatgcagtggcaagatcatggctcagtgcagtcttgacctcctgggcttaagtgatcctcccacctcagcctcctgagtagctgggactacaggcgtgtgccaccacgctcagcttatttttgtattgctttgtagagacagggttttgccatgttgctaggctagtcttgaactcctgggctcaagagatctacctgtttcagcttcccaaatgagccaggagccactgtgctctgctgaacaatatatttctagggatatatatatatatgagattattattcatgtaatcattcaacagaaagggcctagttatgtaacgtctatgataagaacctggaccatctcattttgctaaaaggacttgtaataatagtctttcatcttttattatttgtgcaccaaagtttccttatatggtccacaagtggtcaaatacacagttgtgtatataaggaaattggaaagagatgatgaagaaattttttaaaacctgttgaattgatcattctaatctttgtaataataaatatattgtccttataagtctgtatatgaaaatgtttcacaattatggagcaaagaagatgaccttcctctcaacaaaatcaagttgtcagtttaaaaaactgtattttgatgatgcaaaagaggaatcaaaagtaataagctagaacttaaaagagatgtaaatctggacttgtacattttgacagtgcaagtgcaagaagaaacagacgtagtgatgagctagtacctacctgttagagatgtacttgaaatctagaattgtatttcctagatggatatttttcagatttgtggatgacaattggtgagcagcagtttgttgcatttaaaggctcttgcccatcttggttatatacactttcagcctttggaaaatatgaattaaaatgtgagtcttctggccaggtgtagtgtctcacacctgtaatcccagcatttggggagaccgaggtgggaggactacttgagctcaggagttctagaccagcctggacaacatagcaagaccccatctctactataatataaaaactttaaaaaattaaaacataaaaataaaaaaatgtggttcttcttatgagtacattctaattaagatttctagtaaaattgtttttcattatctttattctacagattatttgtaaaataactgaaaaataattaaaagagtcctttggccctagaaaataaatgacagtgatgatttttcctagcatactaaaggttaagaaattgttcttatttcacgaatgtgtgcattttgatatttggaatctttatgtgaaatccccattttacattgattatataatatattggtaattattaaagatctactatgtccttaaataaatcattgtcattcctcattgattactccttaaggtcaaataatatattttattaaaaactacacgttaagggcatatgtgtgtgcatgtgtgtctttatattctgacattttattcttttgttttgccattgtagtgctgatgagctccttctaactgagatgatgtttaatggccttttcaatgacctttctgcagaacaggcaacagcattattaagctgctttgtgtttcaagagaatgtaagttaattgattcagcacatcttatttattaattcacacatcatgtagttaatagtgttatggctatattatcaaatattactaatatttacatattataaggtaatgttaattggaaatcacagcaactttaacacaaatgtactaagaaaattaaatgattaaatacgtattattagaaaggagaataaaataagatttgtcaacaatcaccattaattagattttaagttttaaatttgttctgtaacccaattcattgaacatttggccaagtcctagacagtcctagaaataaaaagatgagtgagaagaaaactaggaaagtctgataaaaataaaagggggaagtgaggttgaattaactctcctccccggtgttgaagaataatgacgaagcagtccatcctgctaggaactgaaacattagttttcatgggcacggtttgaggtagtgaatataagatccttgttggtttggcagcagtttttttcatatgagtaattagttcactttcaacagttcttaagaaatcaaaaaatgaagtgctgggtggaacacataagaacactaattatccttgtactgcattccaaaaaccagtttgattcatttttaaaagtaagatatattgttttgcatttcaaatttaagactttatttattgtagatgaagtggatagaatgagaataagacaaggacatctgccttctaaaaataatttaatattctaaatttttggaggaccttttactatacatacttagtttaacttttaagtaaattgtgtagaacaaattgtttagtttttttttaagttccacagctcttaaatcttggggcaagatgtccgtatatgcagttaagatgtattcagtgaaaccacacttaattggtctgtttacctgttaactgtttccatatttattaatcagatcaaatatattacttcttgaagtagatgggtacttttctcaggtccctgattactgattagaatcacagctgttagtggcaatgataacaaataggacaataatccaaaaacagtttatgctttcctgggattgcctaccatgcatctatgaaatatgcatacaaaaggaatgcattactttacaaaatattgtgtttgtttttccttaggctcaaaattttattatatcaatttccaagataaagataattaagaacatttgtcaaacttacttggaataggaaggttcagagatgtaggtttgtaaatagtttggggataagtggtcttccacccatgtcaaattttgtcttacttttcattatttgcatgttcttgttgttttatattttggcactattacaatagttcctttttctgagaagccaattatattccctcttcaaaggagttggttaagctaaaccacagctcttaaatcttggggcaagatgtcaatatatacagttaagatttattcagtgaaaccacacttttttatatacagtgtcatcaattcttgtggtggcgccttttaacattgagatggaagattgtactgattgtcatgtggatttttcttgatgcttttaacagaatgttttctgccaaaaagaacattgtcttctagtaaatatagtaaaatacttgttataagtaagatgaaatttgcttgatataataacttctattttaaaatgtatttataaaactgtctctacattttaaaaataatatttaaaaggttatgtaaatctttataatataaagatcaagtgcatacaaaaatttattaagcacccaatgtgggcagtgtacaggtctaagcaccagagatgcagcagaaatgtttgctttcctgatacttacatgttagtggatgaagataaagaaatacagtacacatacattctgtcaaataggggtgaaggtttttggagaaaagtgagaagaatcaaagatcactggggagatggtgttactattttaaataagatgattagaaaaggcctcactaatgaagtgaaacttatattgaggcctataggagagatgagggaacaaactgtacatacctggtgggagaacattgttaaaatcacaattaacctcctcacatcaggactggtgccttccacctatagtgaatagcagagaggaatgtgatgagtagctgttgaccatgaatagacataatatcaaagacatttcgcagtcttgggttctttattaaactgagatgttaaggtcattctggctattttgcttttttgccattcatcaataatttttggttttagcagcaataatatggaatctggttcttgatttattatacatatatacatgttgcaaatcaaaatcaagtcctttataagtactggtgcttaaaataaaggcagatatgtcgcaactagcctacaattgctttaaaaaaaaaaaattagcgatcgggcacagtggctcatgcctgtaatcccagcactttaggaggctgaggcgggcagatcatgaggtcaggagtcgacaccagtctgaccaacatggtgaaaccccgtctctactaaaaatacaaaaattagctgggcgtggtggcactcctgtaatcccagctactcaggaggctgaggcaggggaatcgcttgaacccgggaggtggaggttgcagtgagccgagattgcaccattgcactccagctgggcaacagagcgagactctgtctcaaaaaaaaaaaaaaaaatagccataattactttaattaaaccctgtctcatacatacatacatatcattcttatagtaattttatttttgtacagtacctttgtcaaaaatttcttcacaaataatgtctgttattctcatcataagcctactcattttgaggatctggttttatttttctttgacagggcagaaaaccagtacacagaatttaagcagcttgtccaacttaatttggctacttagtgtacacctgaaactccattatctaattcagaaattgacagaattttcagctgtgggaaagcaatactaagaatactgaaactcagattaaacttttagctgtcttatactttgttagaacatctgggtaaaataaaaattagggacactatttttaacgtactttatcctgagttttcagtttcaaacttttcagtttctacagattgaaagttgcctagaaactaaaactgtttcaaagttaaactatgataaaaccctttaatgttgatgtaactaaactactatgtatgtttacaatatttaccctccctcagttccatatgtaatcacaaaaaggagctagttagcacactttgcaaatttagcggtgtattttcctctgaaatgtaataacagaatattataatttgggatgagaggaatagtgattttgcctgtgtaaactgaattgattagaaactctaaatgctgatgactaaggtcttataatttgatatgtgactatcttacaagctttaatttgttaaaacgggtagtgtgaaaaaccagtaactttaaacgtgggtttttatatcttgttttccttttcttttatagtctagtgagatgcccaaattaacagaacaattagcaggaccacttcgtcaaatgcaggtaaggttttttttttttttttttgaactacatattttatgaatagtagattgtaaaataaacatttttgataatctaatcatagtagtttatcatttcacagagataacctataaggattaaatgttacttgatgtcagtcatgtaatttaatgttactctgataacatctcttgtgatttttactttaataattaaacagtatttcttcccattattgtaatgaactgtatagcattgttgtgaacagagattaaaagcttcataatgtaaataggctgtattgacagctcagtgcatgtgtcattttcttcctcagtactgataatggtatcttgaaggactaggatttagtttatttttaattttttgcacattttttcattctggtttataacaaagtttggttgttttattgttttgtttttgagacagagtctcgctctcttaccaaggcctggagtgcagtggcgtgatctgggctcactgcaacctccaccttccacgttcaaatgattctcctgcctcagcctcctgagtagctgggattacaggcacccgccaccacactcagctaatttttgtatttttagtagagacgaggtttcaccatgttggccaggctggtctcgaactcctgagctcatgtgatcctcccacctcggcctcccaaagtgctgggattacagatgtgagccactgtgcccagcctataacaaagttttaaaatctgttttatcataagaaattgtctctggatcctcaaagccacagtagtttatagtaataaatttctctcttactattttcataggataagccgattttttctgtctgttcaacattagacaaagacaaggaaagatgagctaaggaattacaagagaggaacaaaaaaatgtgtcataaaagggccccttcagaacaacagacactggtgcctacttgagggaggagagtgggaggaaggagaggttgaggaagaaaaaagaaaaaaaaaacctgtggcatattatacttagtactcagctgactaaataatctatataccaaacccctgagtcacaagtttacctagataagaaacctgtacatgaacccctgagcctaaaataaaagttaaaatatttttaaaataataattcaaaaaattctgattaaaattaaaaggccagttcagtggaacatgtaacatgccttaaaatcactaagaaatttaaatttctagaaccagcaaagtcttcataggcctaggagtttttggccttttagattgccaagtaaagaagaatgaagtttctcaacttagaggaaaacaatatgaagatatgtacatttttaagcattgttgtggaaaaatgtattttgctctaggatttgtatttctctaaatctgttttgtaatgaaataattagagattagttaaatgctgctcttgaataattttaatgaagagttctgtttctttgttgaaaaggtatcactggctgaaaagcatgctcttgatacatttttcttagttaactacctcaacataatgggaaagattggccgtttaatcacttagcaatggaacaggcactgtgcctacttaggagcagaatgtccacattgcagacataatacctaggaagaaaaagggacctcctggaatactggcttggaaacctaaagaataaagtgatatgggagatcataagtaaggaattttaactcttttatctttaaaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggtatggttaaattttacacatatatatttacagtataagaaatacagttaggatggtattgttttaattaaacaagtataatatgtatttttaatatttggtaactaaatgaaatcttctccctattatatagattaaaaaatattctccacaaattctttgtattatttaataagcatagtctgttcattagaaagtcctttagaaactattttaaactgtataattctgtgcagttgtaattctatgagtttctacagtcacaagcagatgaccctaagaagtcatatttatgtgggtatttttccttttcacttttgttctcctggtgagctatataattccactaaaaatagcagagctgaaaatgatcagtcattgcatatgtaattgacttggctttagtcagactgttattgcagcatgaatcagattaaatttaatgagcaggattttaagagactgaagaataattgttactcaactgaagagaaattttaaatgaaaaaattaaggcaaaagaaatataaggaataagtgaataataagaagcaaaaaaataagtagactgtttaaacgaaaccatattttaaaatgctgcattcagtaggaaaagattggtttgtgtgtttataaatggccagttgtatttactgaatgagataatttacattgaactttcctaaaaatgaaaataaatgagtttgttctgtatagagattataataagaactgctactattgcttataggtttagtttgagaaaaattacatgtttaacatgccaaatattataggcctttcaactgatattattaaagaagtaatagattactgattttatgaatcagttatttttatgatgcataggttaaacttctctgcaacagaatattaaaaacttaaactgagggcctttactacattgaactttatgggttttaaggtttttaatgttaaagtttatagcacatttttaaattatggtgttgtatcttacatattttttctaaggtttataaacttctcagcctcctctaaatgatcatttagtcaaacagtcccaaagcatcctttgaattctgtattctgttactgggaaagtcattgcccagtaagtactatatgccaaacactgtgctaagagctctgtataatttacatgtaatcaccaaatagcaattcagggtagatattatctccactttgcacaaggagactatggtaaacagtttggccaaggtgatgtgagggcacgatgatttaaactctggtctctgtaactacatgtaagttcagttaagcaccataccaccttatccttaaattttggatcacctgaaaatttcttaaaccctacactagactataccatctccatccacagaaaagtcatgcttggagtaatactaaacaggtcttaatcctagatgatgtttagcaacatctctaattagttaatggtgtttagccgagtcagtgagaagagggatgttgcgtactcactgatgaaaattgcttaaaacaggagcacaggttggtgtatgacaattgtgtttcagcagcactagggcgatcacatagagcaccaccagtcttcagtctgacatctttttggaacataaggatgaaactagtaactgttcaatgcctaataataagacttgataatacaatactcatatttgtataatatctgcttctctgaaaagtcagaacacaatgacataaaacaatagtggtacatggcagagagtagcttttttttatttttttatttttatttttattttttattttttttagaaaagtaaaaagcaggccaggcacggtggcttacgccggtaatcccaacactttgggaggccgaggcgggcggatcaggaggtcaggaaatcgagaccatcctggctaacacggtgaaaccccgtctctacaaaaaatacaaaaaattagctgggtgtggtggcaggagcctgtagtcccagctactcgggaggctgaggcaggagaatggcgtgaacctgggaggcagagcttgcagtgagctgagattgtgccactgcactccagcctgggtgacagagcgagacaccatctcaaaaaaaaaaaaagaaaaaaagaaaagtaaaaagcaagggcagtagacctggcctgtcagatgagtatatttttttttaaatctaggaattcatataaaattgtctttatggattattttttctgttctttctacctaagtagaagttatcacagtatggaagataaatcctaaactgccaaattgaagatggtttgtagctcatactagatgccacctatgagttgactttttccacagcataccagcattcctgaagtctgttctgtcctctttcagttactcaggggctatttctacatcacagtttgcttgaaatttcagtttgaaaatttgagaaatccagttttttagctctaacttgaaattagatctaacatctgcataatttttatgtttttcttgtgtgtgagccagtagatgagcttaaacctttctaaaaattgggatatactatgtattcgcccttaaaactattttttgatttaagtagcaaaaaatgagaaccttcattttcttaggatagtatttctctcttttgtttttacagtgttacatagtgcttccatttcaagaatagccattccttcctcatctcgttattgtatgtggttgttttttattttttgcaacagggtctggctctgtcacccaggctggagtgcagtggcgtgatcttggctcactgcaccctccatctcccgggcttaagtgatccttccacctcagcctccagagtagctgggaccacaagcatgtaccaccatgcccagctaatttttgttaatttttgtagagatatgattttaccatgaagcctaggctggtctcaaactcctgggctcaagtgatccacctgcttcagcctcccaaggtgttgagattacaggcatgagccactgcagctggcctacacatgttttatgattggaaaaatactgtaatcaaagctgtagcacacagtacagtgtgtctgtttttacaggcagacaataattgcattggaactttctaatgtgctgtgtgcaaaccatatttgttcctaataagattcttaattttcttttcatatgaaaataaaagtgtctggtcatttcatatcctgagcctcagaagtagttttaagtattcttcaaacattaactgaggctagttaacactgtaatgattaaaaccatgtgtttgggggatgtgtaatgcaaaagaaaagttcatattgtgattcagttgagaaattttgaagactaagtatttattctgttatcaccctggaaaaaaaatgacagaatttagctgttttttatttccattaaactaaatttgaatgacagtttaaacaaactatttgtatgggctgatgcctagggttttagtcaagtaatccagaggctgttactatttatttctgactctacataaacaatattgtactcttaactatgaaggatgacaaaggatttgctttccactgagcaagtgtcattaggaaagcttctatgatgaattatctcttgaaactatttactgtacctctgcctgccatatgctttttattttttttcagtcctgctccctctgtatgccacatgttttgaaagcaaatactgtgaattgcattcctcaactctccccaccacacacattctctcacatgcctttcaagtagcagtttaaccctttcttagcatcatcagtgtcatgagtggttttccagtggatttgtcttttaaaagtattcttgctgataataatagagtaacaatttattagtaattgtttctgtctttacattttggcacagttttagtacctgatacttactcgtttaatgaataattctgagaccctagtgggaatcaggcaccatgctagttacagtgtgagcaatagtctctgctctcaagaaagggttcagcctaagctggggtttagcggcaagtagttgcaagatacatgtgtgattctaacctgaggccaggctggataggagtattaaattcgggtcagagcatgaactgtaggaaactgctttagggtatgccagaaagctgaaggcagaagttctgttcgggaaaatctgctgctttctctccttaatgagaatgatgctgttttgttcatcaaccgggtaaggctgatgtttattaaaatgctcttaaataaaagcatatagtcccaagtgtccatcgatagatgaataaattgtggtatatattaggttggtgccaaagtaattgtggtttttgccatttttaatggcaaggtgttccattgtaataaagattaaatggaacagctttcagttagaaaagacatactgactcatgctacaatatggacaaaccttaaacacattaagttgaaagaaggcagacacaaaggccacatagtgtataatttcacttatatgaaatgtccagagtaagcagattcatagagacaaagcatagacgtggttgccatgggctggagggacaggaagacatgtaactgcttaatgggaacaaggttttttgggggtggtaaaaatgctctaaaattagataatgatgatggttacacaagtctgaatatactaaaaaccactcagttgtacacttatttaaaataatttatggtgtgtgaattctgtctccatgtgagttcttccagaatgtagtaaacctgaatataaaaaagggcagtaactgacttgtatactttaacatggttaaaaaggtggattttatgttttatattttaccactatttgaaaaattttttaaagacaataactagaaagaattggatttctctttctactctggcaggaccaaaaaaaaaattttgtaacaaaccagtaggttaatgtggttttgttttgtttcggttttggtcagcttcatttagcctatgatgggtcatggctttgaaacttttgtctagcacttagtcaggctgatgaggcaggatgacttataaaggtgggtgtaagaagagcccttggattacagagaactgtagtaggtaggagagatgctagacaattcactacttaatcgtcagtcttcattaatccctggggggagtagcctctatgtttcaggcagctctggacagttagtgtttgtgcacatacccagtgatttgttgatgagactctgtgggcaacaaccacagtcattgtatatgcaaccttgtgcctactggcctaatttgcttgttacctgaaactgtgtcgaaactaaagtttccagaaattgagtcgaaatgtttacaaaatgtgacatgacagtgctctctggcctgaatgtgcatttacttgccttagtttattctttatcttagtaatttacttcgtatggtttggtctctgataactttcacagattctggttaacacgagttactaaaatttgtgaaataataatatcacattgtgtttcttggtacacatttgaagtcagtcaaaacaatgtttgagaatgtgtctggctctttaatgccctgtgcagcagaggactttgtaaaggatttcatttcaatcctaaatgacctgtgagaatctggtctcaggtaaaaatctagttacattttgagccactacctaatttaattatctttggatatacttgtttgcataaacatttaatatctgattgcataggtaatatgacattaccctctctatcccaattcctaccctctctcttgacacccagaagtttctgcagttggatttcctgtttcattgcaaggcagtattggagcctgcattcctagcagctgagaatagaaataacaaataattattattaatttaataattgttaatagtgtaaatagttcattgttcctacagactgcattttgagaactggtattcctaatgtatttcatatattaaaaatgaagtcaagcgttttagatttaggcaggtagcacttagagaaaggatctcacaatctctgctcctctttgcacaagtctagcaaaagtgaaactatgtttatagcttcagctttgatacaaacacttttctcaaacagattctagacccatgggaaaaggcttctttccttgtgctccttgagaacactgtgtaaagaacgtactaatgaaagaatctaaggtcaagaagaatgaatgcacctttaaaatgacaagttttatcttgttactctcctgctaaaaacagtctgttgcattctatgagatggtatggatggtgtccagatgcctcactaggccacactcagggtccttgaatagctgcagtttgccaggcttttctgcattgtcgtggtggtccttcccttgttgctgctgcctgagagatactgcctggttcttacagacacagattatgtcatctttgcagccttcacccaaagttgctccctccttctagggcattttgttttcctacttaataccaagtgtcagcatgttagtaataaacaggtgtctctaccattagtcaaaggtgggagttaagcctttcatctttgtagctttctccagtacctaaccatgatttacttcatgggaagtccctcaaagtactattaattatcgtgtgttctcctgccttgcctcttaacaaaaattctgctgttcctgattatttccattttaccagtgttttgttccttttctatccaggcagcataattcgttgtatgaggcgcctggaagaattgcttcgacaaatgtgtcaagcagcaaaagccattggaaacactgagctggaaaataaatttgcagaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatttatcagatggtgataagtctgtaagataaaaacaaagcagaaaagacaatagaattggcagatggatatgatggtctagggcctccacagggaaggtggcagttaaggcctttggtgtatgcttgatgtacgtgaacaccagcaagaggccagtgtggctggagcagaatgggcagtgagtagaggagtaggggttgaagtgagaaaggaaatgattccatagttcccagccccaggcttctcaactctgcagtgactggaggtgtggagtttgggagtgacctgccccaacttggactttacaaggtaattgttgctcttacattcagggcaagtctgtagagtagcacagtagaagtggggagaacagatcaagaaaggatggctaaaccaaggtggtagtaatggagtggtggtgggggggcaaggggcataagcttcagtcctgtctactgactcttgaccaagaaaaaggactaagttaatcaaagaatataaccacattgttgctgagtcagtcaatgctagtgatttctgcaaacaacttagtgtcctaagaagaggtttgcaaaaactggctgatatttccacagttgataaatgtaggcctgtttaatgactcagaatttaagtgtaggtgtcaaagttttaaaaataatttgtaatcaaaatttgtatttgtccttccttggcctagaaagaatttcacatgggaactgaaaaaaaagtgtcttctgatataggttgaaaatccaagtctttggattttacatttctttagacagtttagtccttccctataattttttttatttttatttttatttatttatttagtgtgtggagacagagtttcgctcttgttgccccaggctggagtgcaatggcgcaatctcggctcactgcaacctccacatccacctcccaggttcaagcgattctcctgcctcagcctcctgagtagctgaactacaggcatgcgccaccacgcccggctgattttgtatttctagtagagacggggtttctccatgttggtcgggctgctcttgaactcctgacctcaggtgatccgctcgccttggcctcccagagtgctgggattacaggcatgagctactgcgcccgacctagcatttatctttttaaacagttctagacacctctttcctggccagcccccatggagtatttcagagtcaaaagaacaggggtctggcttgtatgttttccacctcacagaggtggctgcaaattcctctaggtgttcagcaaggtgtttgactttctaggctgctcgcttaccagttgaatcagggttggtatactggctttaaaatttcggtagaggcaagttaggtgttttgtggtcttgaaagtttaaaccttactttcttttctcttaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttctacatgtgaattagttttttcaagtcataatcccctaaaaaaactatttctagccagagcctttcacaataaaaatactaagattttacaaaactactaagttttagaaagagcaacctagtttttaacctggtgtgtatcctgaagtgacttttaataacattgagattcttgcccactgcatagtcttctcctcagctggggattttttggattttttttttctatttacttatataaatgtttagcaatatcaagatgtaggctgttgacctgtatacttacaactaatattgcaaccagagctccctgaatgagtccagtcaacacatcgctccagtggtgtttataatcagaaactcgagaaaggcccacataaatggatacggcaacaagaccaaattgcagtgtggggcgtaagagtcttgcccagtctcccttcatcctggcttgaagataaagctaaaagaaaagaataaagaaaaaaatagtttatttaacataacgcaaaacttttatattaaggaagggttggcatttgaaatgattatcaaagtattattatatagggaacaggacttctaggcaaacattcacgtacgcattattacctaaatgttaatcctttaaagaaacaaaactattgccctactaacttgttcacaagaatctattgccagtctagctataccacccttcaaactgtatacaaacaggtgtttccttgtttatggctttctaaacaggatttcagggacagttcctccccttgcaatttgggttataattctcatagtcaagaccagtgctgccattggtttttttattgttttccttaaagaaatgggg

SEQ ID NO: 8868 - DNA, 291 bp, Homo sapiens
ttatttttttgagacggagtcttgctctgtcgctcaagccagagtgcagtggcgcaatctcggctcaccgcaagctccacctcccgggttcacgccattctcttgcctcagcctccctagtagctgggactacaggcgcccaccaccacgcctggctaattttttgtatttttagtagagacggggtttcaccgtgttagccaggatggtctcgatctcctgaccttgtgatccgcccacctcggcctcccaaagtgctgggattacaggcgtgagccaccgcgcctggcc

SEQ ID NO: 8869 - DNA, 530 bp, Homo sapiens
ttttttttttatagagatgggggtctcactatgttgcccaggctggtctcaaactcctcgtctcaagtaacccgcctgcattggcctcccaaagtgctgggattacagacatgcgccaccatgcctgacccagtatcgtggttagttctgagtcttgggataaagtgctagcattctgggcacaggttgccattgctctgggcctatctagggactatttcattaattaaccaaagagagctcttctaccctcaaattgtttaacaaggcaactgagactaaataatctgtatttgcaagtaatataggttgtagtttagttatgatccagccaagaagtgtattctttcaacagtacttgtatcccctttaagttaagttctatgagttttctgtacactaatcggacctaagaaattcccctttctcatgtcagtctgcctttgactttgggtgcatctctgaaggttttatgtagaaatgattctttttagggagtctgctctcattaaaaaaaagaaaaagaaaac

SEQ ID NO: 8870 - DNA, 530 bp, Homo sapiens
ttttttttttatagagatgggggtctcactgtgttgcccaggctggtctcaaactcctcgtctcaagtaacccgcctgcattggcctcccaaagtgctgggattacagacatgcgccaccatgcctgacccagtatcgtggttagttctgagtcttgggataaagtgctagcattctgggcacaggttgccattgctctgggcctatctagggactatttcattaattaaccaaagagagctcttctaccctcaaattgtttaacaaggcaactgagactaaataatctgtatttgcaagtaatataggttgtagtttagttatgatccagccaagaagtgtattctttcaacagtacttgtatcccctttaagttaagttctatgagttttctgtacactaatcggacctaagaaattcccctttctcatgtcagtctgcctttgactttgggtgcatctctgaaggttttatgtagaaatgattctttttagggagtctgctctcattaaaaaaaaaaaaaaaaagaa

SEQ ID NO: 8871 - DNA, 310 bp, Homo sapiens
ccttttattttttatttttttatttttttgagacggagtcttgctctgtcgctcaagccagagtgcagtggcgcaatctcggctcaccgcaagctccacctcccgggttcacgccattctcttgcctcagcctccctagtagctgggactacaggcgcccaccaccacgcctggctaattttttgtatttttagtagagacggggtttcaccgtgttagccaggatggtctcgatctcctgaccttgtgatccgcccacctcggcctcccaaagtgctgggattacaggcgtgagccaccgcgcctggcc

SEQ ID NO: 8872 - DNA, 17691 bp, Homo sapiens
tagacaatgcagatagtagtacactccatgctgtaacctttcttcgaactcctgagattcttactgtaaattcaattggacagttgaaaatatgggatttcagacaacaaggaaatgagccttctcagatattgtcactgtaagtgttgatttgtaatttcagtaatgtaatccacaaattaatgtgttaggttgtttatagctactggctttaagccatattgaattttaattgcattttaagagggagatccctgattaaaatttggtagagcaagcataacttgacggggttggtactactatgcttcatttagtaattatttgttatagtgattcagagcctttactctttgaagtttgtattatttcatggagaacttatttctgctctttcaatgattgtttaatggataaaatatactccagatgtaatgattgggggaaaaatataattccaaatattttttctgagcagaaatccccctttgtaggtgtacaacgttctctcgtaagaaaatagaatgtgtcacactgaaaaaatagttacataaactaagcattaaataagatgataaataatatttagtatataattgatgtatgagtttttaaataatttaacaagtggaaatgtgatttgtacatcttaccatcggattgtctttcattccatgtctccaaattgaagtgaaaatgaataattgtggccttgaattatttcaaaattgtactatttagaaatatatctaatttagttcattttttttggtatcattaagattcagccaggctgggcgtggttgctcatgcttgtaatcccagcactttgggaggccgaggcaggcagatcacttgaggtcaggagttcaataccagcctggccaacacagtgaaaccccgtctctactaaaaatacaaaaactagccaggcatggtggcacgtgcctatagaccccgctactcaggaggctgaggcaggagaatcacttgaacctgggagccagagtttgcaggagaatcacttgaacctgggaggcagagtttgcaggagaatcacttgaacctgggaggcagagtttgcagtgagctaagatcgtgccattgcactccagcctgggcaacaagaacaaaactctgtctcaaataaaaaaaagattcagccagtagctccagccactaagttgacacttagttaccatataaaacatgtttcttggctgagcatggtgactcatgcctgtaatcccaacattttggaaggattatctgcggtgagaagtttgagaccagctagggcaacacagtgagaccccatctctaccaaaatttcttaaaatagcctggcacggtagcatgtgcctgtagtcctagctacttgggaggctgaggcaaaaggctcttttgagcccagcttgcagcaagctgtagataggccattgcactgtagcctgggtgacaagacaagaccctgtctctcttttttttttttttctttgagacagagtcttactctgtcacccaggctggagtgcagtggcatgatcttggctcactgcaacttctgcctactgggttcaggcgattctcatgcctcagcctcccaagtagctggaactacaggcatgtgccaccatgcctggctagtttttgtatttttagtagagatggggtttcgccattttggcctggttggtcttgaacctcaagtcatccacctgccttggcctcccaaagtgctgggattacaggtgtgagccactgagcctggtctcttaaaaaataaacaaaaaaaaacaggctgggcacggttaccagtcatcccagcactttggaaggccagggtggctagatcactggagcctgggagtttgagaccaacctgggcaacatggagaaaccccatctctacaaaaatacaaaaagttaaccaggcatgatggtacacacatgtactcccagcaactcaggaggctgaggtgggaggatacctgagcccagggagtttgagcctacagtaagcaatgattgcagcgctgcattccagcctgggtaagtgaggccttgtctcaaaacaaacaaaaaacgtgtttcctgtgttacacaaagataaattatactttatttgattttgacgtcattgttatctcccacaaaaggactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaagtaagtattgtgaagatacagaaagtttatattgggtgagttatatgacatataataagcacctttccataatgatacatgtggatcattttacatcatagcttttaatggctgaattgtgtaaatttaaatagttatgtaatttctttttactcgacatttaagttctttaacatttgtttttgtttttttggagacggagattcacccttgttgcccaggctggagtgcaatggcgctatcttggcccaccgcaacctctgcctcctgggttcaagcgattctcctgcctcagcctcccgagtagctgggattacaggcatgcaccaccacacctggctaattttatatttttagtagagactgggtttctccatgttggtcaggctggtcttgaactcctgacctgaggtgatctgcccagctcggcctcctaaagtgctgggattacaggcatgagccgccgtgcctggtttttttttttttttttttttaaagagacagggtctggttctgtcgcccaggctggagtgcagtggtgcagtcacggctcactacagccttgacttccagggctcaggtgatcctcccgcatcagcctcccaagtagataggactataggtgtgtgtcaccatgcctagctgattttttgttgttgtttgcttttttttttgtagatatggggtttcactttattgcccaggctggtctcaaactcctgggctcaagtgatcctcaggaagtgctgagattacaggtatgagttatgagccaccacatcaaccacaggtttaattcttatatccaaaaactgtagttagaatccttagatatttatctctgtgtgtgttttttttttttttttttttttggagacagggtctctctctgttgcctaggccagagtgcagtagtggtgtgatcatagctcattgcagccttgaactcctggacttacacgattctcccaaagtgctgggcatagccattatgcccatgcccagccttatgtacttattttcttaggataattttttagaagtagaattgctaggccaaacattttgcatagcgcattgacagatttttctacacaaaaataataccagtttaagccaggcacattggcacatgcctgtagttccaggctcctcctactcaggagcctgaggcaggaagattgcttgagcctgagagtttgaggccagcttaggcaacataacctctttaaaaagttaataatactagtttaatccaggtgagtggcatgcaccagcttctcaggaggccgaggcaggaggattgcttgagtccaggaattcaaggctgtagtgcattatgattgcacctatgcactccagcctggacaatatagtgagaccccactccctgaaaagtgataaaaatcataccattttatatgccatagtgaagtgtgcaagaatgcccttttcccatgcaaatgcaggctgtcatatttgttaataaatgttgtgctcctcaatttattgttgcatcacatcattttttttaacatgaacaatagatttataagcttttttttttcttttgattctggtggagatgatttagccggacagaaatttttcattttctcactctgtctttgatatcatgccagaatggattatccttttttttttttttttttgagacagagtcttgttctgtcgcccaggctggagtgcagtggcacaatcgcggttcactgaaacctctgcctcctgggttcaagccattcttctgcctcagcctccctagtagctgggactaaaggcatttgccaccatgcctagctaatttttgtatttttagtaggaatggggtttcaccatgttggccaggctggtctcaaactcctgacctcaggttatctgcctgccttggcatcccaaagtgctgggattacaggtgtgagccactgcgcccggccctatatatttttttaaaaatggggtctctctcacccaggttggaatgcagtggcatgatcacagcccactgcagcctcagccttgcctccctggctcaatcagtcctcccacctcagcctcccgagtagctgaggctacaggcacgcacccctactacacccggctaattttttattttttgtagagacagggtctcaatatgttgcccaggctggagtgcagtggcatggtacctcacttaagcctcaacctcctggggtcaagtgatcctcttgccttgcccttctgagtagctgggactacaggtatatgccactacacctagctaattttttttattattagatttctatagaaattatgattccataaaagattttgaggaaatgatggccgggggcggtggcttatgcttgtaatcccagcactttgggaggccgaggcaggtggatcacctgaggtcaggagttcgagaccagcctgaccaacatggagaaagcccgtcgctactaaaaatacaaaattagccgggcgtggtggcacatgcctgtaatcccagctactagggaggcagaggcaggacagtcacttgaacctgggaggcagaggttgtggtgagccaagatcgcaccattgcactccagcctgggcaacaagagtgaaactccgtctcaaaaaaaaaacaaaacaaaacagattttgaggaaatgaggaagactggtatctttcagaattgaaagtgattttggaatatatagaatttctttggggctgggcacggtagttcatgcctgtaattttagcactttgggagtccaaggcaaacagatctcttgagcccagttgtttgagaccagcctgggcaacatggagaaaccccatgtctgttaaaaatacaaaagttagccaggtatggtgatacatacctgtagtcctagctactcaggaggctgagataggcggattgcttaagccttggaggtcaaggctgcagtgagccatgaccatgccattctgcactccagcctgggcgccagagcaagaccctgtttcaaaaagagagagagaatttctttgagttgaattatgtagaagtttgtcactgacctatgttcctaaagtatgaagcatacatatgtgggctaagaaatagtttttcttgataaataatcaacaaataaaaaataaaaagccctccatctgagactggatccaaattcttggaacatttccaaattttggtttggtagaagtcagttgctatttctgtgataaagaccagaagtattcagaatcttggcattaaccaatattggatattgcctcttagaaattcatttttatatttcattaggatctttctcagttttttccaataatataatcttgcatatattaatgacacaggaattgaaaaataagacaactaaccaatttaaaaaaaaattttccgtaaaagacagtcattcctagctgggcacacacctataattccagcacttttgggaggctgaggcaggaggattgcttgacgccaggagtagaagaccaaggtagacaacatagcaaaaccctgtctctatttaaaaaaataaaaataaaataaaataagctttttcataaagtaatagggttaaatgttttagcaatgattttcttttcttttttttgagacgtagttttgctctttttgcccaggctggagtgcagtgatgcaatctcagctcactgcaaccttgcctcccgggttcaagcaattctcctacctcaccctcccaagtagctgggattacaggcacctgccaccacgccgggctaattttttgtatttttggtagagatggggtttcaccatgttggttagctggtcttgaactccagatctcaggtgatccactcacctcggcctcccaaagtggtaggattacaggcatgagccactgcgcctggacatttttttttttccttgagacagagtctcactcttgttgcccagactggagtgcaatggtgtgatgttggctcattgcaacctctgcctcccgggttcaagcgattctcctgcctcagcctcctgagtagctgggattataggcacccaccaccatgcctggctaatttttagtatttttagtagagacggagtttcaccacgttggccaggctggtcttgaactcctgacctcaagtgatccacccaccttggcctcccaaagtgttaggattacaagcatgagccactgtgcctggctactattttcatttatttccttgcccagtacgcaaatttagttggcttctttttcctttcttttcttttttttttttttttctcagacagtgtctcactttgtcgcccaggctggagtgcagtggtgcgagctcggctcactgcaacctccgcctcccaggttcaagtgattttcctgtctcagcctcctaagtagctgggactacaagcacgcgccaccacgcctggctaacttttgtatttttagtagagatggtgtttcaccatgttgcccaggctggtcctgacctcaggtgatccacccgccttagcctcctaaagtgttctttttcctttctatgtgttatagccattggaaagttacattatgtcttttctttaattctgaagcctttaatttttaggacagacttgaggctcgaaggtatgtgatggaggataatggaagatgatgcctagagatgggggtttaatgttgtttgttcagcgaatctgcacaggaatgagcttattgattcttgtctcttagtgtgggaagttcactttcacccatccaacccagaacatctttttacctgctctgaagatggatccctctggcactgggatgcttccacagatgtacctgaaaagtcgtcactctttcaccaaggtaaaactttttaatgaatactgttatgtgtactttttttttttttttttaagacagagtctcactctatcacccaggctggaatgcagtggcacgatctcagctcactgcaacctccgcctcctgggttcaagcgattctcgtgcctcagcctcccgagtagccaggactactagtcatgcaccaccgtgcccggctaatttttttgtatttttagtggagatggggtttcaccatgttggccaggctggtctcgaactcctgacctcaaatgatccgcctgcctcagcctcccaaagtgctgagattacaggagtgagccaccacacctggccttttttttgagacagagtcttactcagtcacccagaatggagtgtagtggtgcagtctcagctcactgcaacctctgcctctcaggttcaagcttttcttgtgccttagcttccctagtagctgggattacaggtgtgtgccaccacaactggctaatttttttgtatttttagtagagatggggttttgctatgttggccaggctggtctcaaactcctggcctcaagtgatctgaccacctcagcctccccaaagtgctgggattacaggcatgagccactgtgcccagcctgttatgtgtaattttatcatacttttattttgttttttttttgtttgagacagcgtctcactctgacatgcaggctggactgcagtggcatgatcacagctcgctacatcctcgccctcctgggcttaagtggtcctcctgccccagcctcccaaatagctaagaccagagatgcttgcaaccacaaccagctaattttttttttttaatttttttgtagagatgagctctcactatgctgcccaggctgctctcaaactcctgagctcaagcaatcttcctgcctgggcctcccgaggtattgcaattataagcatgagctggctgtacccagccattttatacttttaaataccaaattagacatcctcgtattttttacttaatggcaaaacatttttattctcttgcctcagagtaaatttgagtatcacagggcttgaaatctgactgtcaagttacttactactgtatggctgatggctagaaatgctgtaagctggctcacttgagacagccaaggttctcctttgtgagtgccattaacctggaccctcatgccatagcatagacagtggcaaatctttcatattgcattgccaagtttgtgtgaatggcaagaaaaaagttgatatttgatgtaactgagggtactggttaaatggcctgatctcaggccgggtgtggtggctcatgcctgtaatcccagcactttgggaggccaaggcaggtggatcacctgagtttgggagttcgagaccagcctgaccaacatggagaaaccccgtctctactaaaaatacaaaattagccgggtgtggtggctcatgcctgtaatcctagctattcaggaggctgaggcaggagaattgcttttacccaggagacagaggtttcagcgagccgagattgcaccattgcactccagcctggatagcaaaagcgaaactccgtctcaaaaaaaaaaaaaaagggcgtgctttcctcattacagtcagttgtaggttatggtcagccaaagaccatgcacttgtaatcggggtttatgtgtttttgcattttccaagtttcctgtttttgagggtttgtctgtggctccaaagttcttttgcttattcatttattcagaaatatttactgaatgcctaccatgtggtaggcattcttctaggtgttaggacgtgtaacagtgagcagaacgaaatgtcgaaacgcatagagcaaatattctaatagttaaaaaaatagataatgtatcagtaagagtccaattagaatgtcagaaactaccttagatgtagaaggaattggtctcacatgtgttagaagggctgggaaaacaaaaggtaataggaggggtgctgggagaacaaataggaagaaaagggaaaacccagaaatagtaattgttagtacccctgctacttgactgttgaaaatgctgtaaaagtttgttctgaattaggagaaaaggcgctccctcaaccaggctgaaactaccaccagtgttgttgccagaaacctggagcaggaaggagctgcttctcccttccgccttccagtcacccaccattaatacctgctattggcaaggcccatctggatggcagatggcaaagcagcctggaaagtggagtttaccaacttctacctcctacagtatatagtggagcacagcaaagtggaaaaggaggccgggcgcggtggctcacacctgtaatcccagcaatttgggaggccgaggtgggcagatgacctgaggccaggagttcaagaccagcctggtccaacatggtgaaaccctgtgtctactaaaaatacaaaaattagctgaacgtggtggtgggtgcctgtaatcccagctactctggaggctgaggcaggagaattgcttgaacccgggagttggaggttgcagtgagccaaggtcacgccactgcactccagcctgggcaacagagcaagactccatctcaaaaaaaaagaaaaaggaaaataacatggccaaatacactgctaattaccatgaagaagaatacagcagagtaggaggataaagaataaagacaggggtgaggggagctactctagtgagagtcagaagaggccacttggcagaaggaacatttgagcagagacttaagagaagtgaaggcataagtgacatgaaagcattccaggcagaggaaacagcaaatgctgagggcctgagacaggcagagaactgcaaggacaccacggttggagctcaggcagcagggtacagtggtgggagataaggactggtggctgaggagcccctgggactttgtagcccatgataaggactttagacttatgggagggggaggagaaaagtggaaaacagggagatgaggaaggagtcttatcacagtggcttgaataatgtgttaatctttacagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagttgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaatttttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatatatattttttgagatggagttttgctcttgttgctgaggctggagtgaaatggcatgatctcagctcactgcaacctccgtctcttaggttcaagcaattctcctgcctcagcctcccgagtagctgggattacaggtgctcaccaccacacccagctaatttttgtatttttagtagagatggggtttcactgtgttggccaggctggtcttgaactgacctcatgatccacctgcctcagcctcccaaaatgctgggattacaggcttgagccactgctcccggctgatttttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctataatcccagctacttgggaggctgaggcaggagaattgctcaaacccgggaggcagaggttgcagtgacccaagatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaactgaaatttgcttctatctgtcttatctcgggagccacacacacaaaattcctctcatcacatattcaaatattcaaaattgattattatagtctctccagtgaaggtttccttctctttctttccatttttggctaaatccttcttatccttcaagactccttctaggtgtcattttctccagacagcttttattggcctccagcaatccggactaaattgcactctgcttcaaaagcccattgtgcagaacttaaattgtgcgcaaagcagtgtgttaaggagcctgtctccccctactgggccacaagatcaagaacagcgcccatgtcttcgtgtaacagtgtttaacagtatctgaaccatagtaagcaatgagtcactgttaattgaccttgttttcacaatcttgttttccctttaaaaattactgctctttgtcaaaggcctttttttttttttttgagactttaagtctcgctctgtcgcccaggcaggagtgcaatggcacgatctcagctcactgcaacctctgcctcccaggttcaagcaattctcctgtttcagcctcccgagtagcagggattacaggtgtgcgcccagctaattttttgtatttttagtagagacagggtttcaccatgttggccaggctggtcttgaactcctgacctcaagtgatccaccctcctccacctccgaaagtgctgggattataggcatgagccaccgtgctcggccagaggccttcttttaagtgtgacttccaagataaacactttttcatatattgtctaccttggtgattatgacagaaatcttgccatcctgttaataggaatgatattcctttgtaatgctgtgtcagctttctgaagtgttcacatgtgatactcctaagccacacttcctatattcggaagttaatacaaatggtttttaatccttaatatgggcctttcttgttctaagaaaaatttcatttcaatataggaaaggactaactattttctttgaatcttttgtagaagctattattttctccataattagcccagcgtgctctctccactttcatcccattgattaagaaagatgtttgagacaggatttcactctgtcacccaggctggagtgcagtggtgtgatccccagctcactacagcctcgatatcctgggcccaagtgatccttccacctcggtctcccaagtatctgggactgcaggcatgtaccaccaagcctgactaatttttgcaatttttattgagatggtgtttcactatattgcccaggctggtcttgaactcctgggctcaagcaatctacttgccttggcctcccgaagtgctaggattacaggcaagagccaccatgcccagccagaaagatgttaaatgaaatgaagtttttaggcccactgctggagtcttctcaattatcaatgaaacatgaatctctggtatttggctacagttactgaaatatttataaaacaacctaatttattgacatttcattccatttatcttatttccaaggttattgtgagaaaatgtgctgtagttatactatcaaaaatttggcataattgaaaaattcctggtcctttgtgaatagtacttttatttaattgtattgtggaaacatccttttaataatccactctagactcttgtccaagaagcatattaaattcaacagtatatagtttatattgaacctttagttaagcttatggtgtcaatagtatctagctcagactaatagaaggtctggccaggtgcagtggctcacgcctgtaatcccagcactttgggaggccaaggggggtggatcacctgagatcaggtgttcaagaccaacatggtgaaaccccgtctctactaaaaacacaaaaattagcctggcctggtggcaggcacctgtagtcccagctactcaggaggctgaggcaggagaattgcttgaacccaggaggcagaggttgcagtgagcggagatcgtgccactgcactccagcctggcaacacagcaagactccatctcaaaaaaagaaaaaatggggctgggcacggtggctcacacctgtaattccagcactttgggaggcggaggcaggcggatcacctggggtgggaagttcgagaccagcctgaccaacatggtgaaaccccatctctactaaaaaaaaaaaaaaagaaaattagccaggcatattggcacatgcctgtaatcccagctacttgggaggctgagccaggaggattgcttgagcctgggaggcagaggtgcagtgagtgagccgagattgcaccattgcattctagcctgggtgacacagcatgactcaaaactaaattacattaatttaaatttaattaaagtattttttaaaaaatttgtagctgcaaaaaatcagaagagtttttacccctctataggggtagaataaactaaaaaatcttagccagagaagtcttagaatccatgatacaccagtagcaaggcatacacctagcacccagatttggtttcttataccatattccaataaaaggaaccagggatccttggaggaatggtgatccctgaaccggggcaagaaatatacaagatatcttggagaactgggcgcggcagctcaagcttgtaatcccgcactttgggaggccaaggcgggcggatcgcttgagctcaggagttcaaggccagcctgggtgacatagggagacctggtctcgacaaaaaatacaaaaattaggcgtgccaggcgcggtggctcacgcctgtaatgccagcactttgggaggccgagatgggcagatcatctgaggtcgggagttcaagaccagcttgaccaacatggagaaaccccttctctactaaaaatacaaaattagccaggcatggtggcgcatgcctgtaatcccagcttctcagggaggctgaggcagaagaattgcttgaacccagcaggcggaggttgcggtgagcagagatggcgccactgtactccagcctgggcaacaagagaaacttggtctcaaaaaaaaaaaaagttggacatggtggcctgcgcctgtaatcccaagttacttggatgctgaggcatcacctgagtcccgggggttgaggctgcagtgagccataatcatgtcactgcacttcaaccagggtgacacagtgagaccccatctaaaaaaaaaaaaaaaaaaaaaaaaaaag

SEQ ID NO: 8873 - DNA, 109 bp, Homo sapiens
tttttttttttttttttttttttttgagacagggtcttgctctgtcacccaggctggagtgcagtggcatgatcccagctcattgcaacctctgcctcccaggttcaag

SEQ ID NO: 8874 - DNA, 1511 bp, Homo sapiens
tctgggctttctccaaggatgaacctgcttattagagcttggcctgtgatttcttacatttcttatagtttaatggttaagagtgtgggctgtgtaccaggttgcctgggttcaaatcccagctctgacacttaaaggttaagtggcctagacataacttccatgcacctaacctacctgaagagttgctaagcagattagatggattaatacatctgaagagcttagagtggtgcctggcacatgatgaacactccatcaactagtcatggattagtcgttcttttcctgccttcctctctagccttgctgctcaagagccatagactaagaatgagaagggctgttaaagacacctctagtgcagccttttaaatttaccgataagaaatcagaggcctgaagagaagtgagttgcctgaaagcccacagcaagtcagtgacaggccaagaccagatccaggctgcctgactccagtttcttcctcgggcccccatgacctttccaggcgccatgtatgtttctccctggtctcagggtgagggtagaagataacctttctgaaagaggccacgtccctggcctcccagtgaagcactaggtgaagccaggccaaaaagaaagcacttctctggagacagtttccaggagatttttactttcgagaagagctttattatttttgtgaaaatcatacatgcgcatagcttaaaagattcaagccatttgggaaagtacaacgaaaacagcaaaagtcccctttgattctaccactgggattcagccactgttatatgttggtaaacatccatctggacatcttgtacatatatgtagacattttatttctttaattatctttcttattgtgtttgatttgtcgagcaaagttcattttctggctctaggtaagcattccaaatagtgaaactcaaatagtgaagctgaaagtggggcagccttcatattggagaagtggccagccgtgcctaacgggctgtcagagatgatctcatagcatcagactgggctcaggcctcgggcacagagaggtcctcccctcccccagtctggccacagagcctttaaaatccagagaatcagggctgcagccctgccaggggtttggagaaccttccaacaccttcattttatagatgagcaaactaaggccctgagaagtgtccttcgctcttaacctagactttgtacatggtctcgttccccgctttaatagaggaattgctttatgtcgtaggactggaccttgctgcctttgggttggttcctggagaagcaggaataaccacctgccctcctgcccggaggcctttcttcccaggtgactcacagtgccaccctggggtggggctcacggtcaacctgataagggactgataatgaaatttctgtaccaactggctccacacaggggaaagatgttttctgggtaagtctggtcagaagaggttgatggggggaaaacaaaacagacaaaaaaaaaaaaaaa

SEQ ID NO: 8875 - DNA, 1511 bp, Homo sapiens; identical to SEQ ID NO: 8874

SEQ ID NO: 8876 - DNA, 2176 bp, Homo sapiens
aaaacaacaaagcagggtatctgtcaattgatctgtagacccatttcctcatcacaccccaaatctgttatgtggtggctatgcatttctggatctgaggcatttgtgtagttagttttaaggtatgtttatttattattttattactgtgaacagattgcagtgtgtgtatgtgtggtgtgtgtctgtgtcttctgcctagaacaataacctcctttcctttctcccacatcactgcacttttggctgccgctgtggtttgttgcaaatctgagctcatttaatcccacagagtattaaacaatatctggtctcggtggctctgtcattccactgcaggcgtcccaccttcatttgccagctgggatctcttaatgagctagctgtgcacagttcaatagtaaaacccttttagctggtgaaatatgtttgaagaactcactgttggagtgttccatgtgaggcctgcttccactcttgctggcattctcttttcaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgaggtaagccgtgcattgcagtctcgcgagtcacactctcttttctctggctttgccgctagcacaaccctaacttcttgcttggaagcttgctcacaagtcagagctatcatgtcagttctgctgattcctgtttccatgcaggtttgctcatagccttgaaaacaaggtcatgggagagctctatgctcactgctatggccattgttttataattaagtgaaatatgtacatagttctgaaatcaaatctaaaaaacaagatttattcatagaagtctaacttgtatccttgtcccctttactccatgatcttttcccctataggtaatcatgttttggaagatcttggtttatccttccatttgcaaaattacacatatatatgtaacaaatcacacacacatgtgcatattcatcctggtccctttcctcctttcttcgattaacagcagcatgccatatatacttttctctactttgcattttttttcatttttatttttttattttcttcaatcagctttctcaggttgaatctctactttgtatttttcaactcaaaacatattctggagatcactccctacggtacatgcaggtcataattcctcatttagagctgcatggtgtttcattctatggatgtatcatagttaaccagccccatattactgctggacatttggattgttttcagtctattgctattacaaacagcactgaagtggataacagccttatgcatctgtcatagtgtctggtctcagtttatatatttttatcataataaaacattatccattaattcttatttcaaatcttttaaaaatactatttttgtcagtatttctttgggatagatgcctagaaatgaaattgctgggtcacaaggtaaataaaaatgtaattttattaaatattatcaaatttccttccataggtggtgtaccgttttgcattcccatcagcactgtatgacaatgcccatttcttcatattcccagaatgtgttgtcaaactttcacgatggctattttatgttaattatactttctgccattttactaaattcttttattggttgtgtcagcttttatcattgcttttcttggggttttcaggtatatttttatatcacttgcacatagagattgtttagttgttgttctgtctttaattgttttcttgtttgattgctttggcttatagctcgggttttatgttaagtagtagtggagatagtgggtgtccttggctctgcacctgacctgagtggggctgtctctagtgcttccctattaagtaagctgctggttttgggattgagatttatatagttttatgtgccactgcacctggcttatgataaaaagtatacatcagtcaggtacagtgacacatgcctgtagtcccagctaccctggaggctgaggtgagaggatcacgtgagcccaggaagttgagaccagcctggacaacatggtgagaccccatctctttaaaaaaaaaaaaaaaaaag

SEQ ID NO: 8877 - DNA, 102 bp, Homo sapiens
gatacagcttctctctctctctctctctctctctctctctctctctctctctctgtctctcggtctctctctctctgtctctctctctctctgtgtgtctct

SEQ ID NO: 8878 - DNA, 8207 bp, Homo sapiens
  misc_feature (2330)..(2330): n equals a,t,g, or c
gctggtctcgaactcctgacctcaggtgatcctcccgccttggcctctgaaagtactgggattacaggcatgagccaccatgcctggcgtttttttttttttgtttttttttttaatagttattttggttgtgccttggtatcacagtgtagttttaatttgcatttttaatagatatttaaattgagcaccttttcttggtttattggctactcagacagcctcttttatgaagacatccaaatatattctacgtttgagtcttttgtccatttttctgttgggctgtcttttttttgtttaataggaattctttatgtaatctgtcaggtagtattttatctccccagattatatttttagtttttaaatgatgtcttctgatatacagaagttcatgatgttataattgaatatgtaacttttttctctttctgtatcctgttcaagaaatagttgtctactccaaggtcatgcagatgtttttttctaaatgctttattgtcttgtcttttattttttatatctatggtctatttggtatggcttcgtgtgtgtggtgtgaggtagggattgagattcttttttttccattgggatatctgattgacccagcatcattttctaaaagatgcctttcctcattgcactgcggcgcctcctgtgtgcttttgacagggatgacagggatgaggatgataaagaataggcatagcgtgtctttctcttgtgagacacagggattccaactcctattctcaatcttaaaaagaagttatttttcctcctccaagtgggaattttactagtgcttctgcttccaggataccaagggttcgagttttggaggatgaagaggggtcgaaggacattgaattgtcagatgacccttatgactgcatacgactaagtgtggagaatgtcccctgcattgtcactctgtgcaaggtataacttgtattttatggtttttgtcttccctgtgggtgtgggtctcctctaatcccaacctgctgaggttacttaataagttaagaagttgtaataccacacaccatatagaagtagcttttacccaaatccaataatttggttatactagaaaccactaccacgagtagctctttcttttctttttaattggaagatatgatgtggtcctgggagccatgagtgtgtttgtagtaatagtagccagagtttgttaagctccttccacataccatgtgcttcactaaagcaccatgtcttttaattacctcaactctatggggtctagggtggttgagtagtggcagggtggcgaacactgtcccccctatgaaatgggaggttggagcaggtcttgggtatcatgagtggttttcacatagagggctgtggagctgaacatcaggctgatgtgatatataactaatgctgccccaggctgtgcaaagaggcctgtattggctattgactgggattgtagctaattccactcaggattcattatctcaaaataaagctaaacaggtcaggtttaattccactgaaatcacttcatgaacaggatgtggtgaagtgttcagacaacaggatggcaggatgttgggtcttggccttttttttttttttttttttttttttttgagacagtcttgctgcagacgcccaggctggagtgcaatggcgcgatctcagctcactgcaacctccgcctcccaggttcaagcaattcttctgcctcagcctcccaaatagctgggattacaggcacgtgccatcatgcctggctaatttttgtatttttagtagagacggtgtttcaccatgttggccaggctggtctcaaactcctgacctcgggtgatctgcccacctcagcctcccaaagtgccgggattacaggcataagccaccgcacctagccggcttgttctttcttgttggttaattgtttttttttttttttttttttttgagacagagtctcgctctgtcgcccaggccggactgcggactgcagtggtgcaatctcggctcactgtaagccgcttcctgggttcacgccattctcctgcctcagcctcccgagtagctgggactacatgcgcccgccaccgcgcctggctaattttttgtatttttagtagagacggggtttcaccttgttagccaggatggtctcgatctcctgacctcatgatctgcccgcctcggcctcccaaagtgctgggattacaggcgtgagccaccgcgcccggccttgttttgagacagtgttgctctgttgcccaggctggagtgcagtagcacaatctaggctcactgcaacctctgctgcaacncccccacccgccccggctcaacctcaagcaacccttccacctcagcctcccaagtagctggtaccacaggctcacaccaccatatctggctatttttttgtatttttggtggagacagggtcttgccatgttgcctgggctggtctcaaactcctgagctcaagcattccattttcctcagcttcccaaagtgctgggaggcatgaggtccggcgccccagcataggcttgttcttgagtgtgtcccttagcatggaccctcttgattcccccttgccatcagtgaaacgtccatgtggccttgtgtgtgaatttctccctgtgtgcccctctgttggaaagccttggtggcctttgtcttggttggtctctgaattctagttttaaaccaccttgccctgtttttccatatcgtgtttttattgtaccacccacacagtggcctgtgagaattgttgaacaatccctcagctgttttcctcgtgagcagaatctaaaataagacctggaatgaccagtgcaaatacttttgcctggtgtagagattcccaccacgaggccatcaggggtgggactctggggcctgcgtgacccaccgtgtgccacgcaccctgcctttgcagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggaggtgaggccttagttctgaggaaggtgcagggacctggccggggtgcctgctgcttcctgctcccttggtcataccgtggggattctccccattcacagccttgaccccaaacttggagatttgggaacagctggtttgagccaggggtctgctgacctaatcaaggggggttgtgggggtggatactctggactgggaggtaaggagcctaccagtaaccattaattgtcctcagtaagtaccccccatctcatttctatgtgtctaaataagactgttggactttcataatgtaaagagccactcgtaactccaaaagtgcaggcctttgtgacttgatgagggaatagaattcttggctcactgcttcctgtccctagaagtgggtgagtaaaggtggaagcacgggctgaactgtggctgtctcccaaattcgttacagctctagaagtgtttaaatggagacaagcagggatggtaagaaatctgacccactggagttgggttgggttgccctcatccctagcagagccatcaaggcgcttctacagttctctgtactgtttgccccacatgtctgtcacctcactggcctggaagccccgcagggcagggacagggtcctgctcacctgtttcccagaccttctttcccctatatccacctcacctttctgactgattgactgactgaacttccaggaacagagttagcaggatctgattattcatactttcttgcaacctctatatcaccacacatgcccagagatcattgcttaatagcaagcactcttcttttgtgtttagaaacaatgacttcatactgaagaatccaagaacatgacatctactttctctctttatcatgttatttaaaaggccaaaatgagcactgtatatagcatggagttcccaaccatgggctgtgagggtgtactgccctggctgcaaacctggctctgggccatagtccccctcatctgcaaagtgggactgataatagtaatatctgcccagacactgctgaggttgttattaggatgatgtgaggtgtagaggagaagcacatgtcacagtgcctgatatgtcatcagttctcagctaatggcagctcttattctctgtgctccatgaagcaccctgagttcaaatttctccagacttaatgctgcataaattctaccaaagtcctctaggcaagggactgtcaaaccttgttttagaaggtactcttccccctcccaggagagtttatgagaatttctttaaacagcaacaacaagcacagtaaacaaatagctggagtttattgtgtgcgtactatgtgccagatactgttttcactgctttaaatatatcatttagtcctcaacaacctgtgaggtaactattattattgtcctcatttttacagatgaggaaactgaggcacacagaggataagcagcttgcctacaggcctccctgctcataaatactggagctaggatttaagccaagactgtgtgcgtccagagcccctgctcccagccactgtgcaatgtcagccttataaaccagatctgccctggctgtcatagatggcagaaccagagctctgttcagtgagctgagctttgtcctcccctcaggtttggggagtgaggtctgctaactctggacaggggactatagctctgtggccctgtcttactgtttatctcacacagggatgcagcaatctggaaaatgacttggtggagctgagagccttgggggtagttgtgcaggctgccacccctagcctctgcagttgctttcctgcatctggattcagaggcgtcaaggccctctcaagtcctggcatcctgtccatctcatctcctcttgttgtcctctctccccaccctcatgtatatgaataatcagtacccctgtttgacagattcagacttttttttctttttctaatgttatgggaaaatctttccaaaggccctttttttttttgagatggagtctcacactatcgcccaggctggagtgcagtggtgcgatctcagctcactgcaacctccgcctccctggttcaagtgattctgcctcagcttcccgagtagctgggattgcaggtgcccgccaccactcccagttaatttttttgtatttttagtagagacggggtttcagtatgtttgccaggctggtcttgaactcctgaccttgtgatctgcctgcctcagcctcccaaagtgttgagattacaggcatcagccaccacatccagcccccgaaggcctttttgacctttaaccctgactttgcatttcatagaggtgatcacttcccagccttttagatcgaaatcatcttttcataagagttttagtcatacttgggatctcatcccatgttacagttaggggccaggggagaagacacacaagtcattactctggggaggatacacctgtaactgaagagattgaggcagggatttaggcatggatgtttttatctcaacattgttgagaatggaaccagtggcagagttgaatccacactgctatgggaatgtgaaagacctgataaggtagagatttgtggttggttctttgtattcttaaaatgattcttgggcccagagacagaataacagtttcataaagaaaaatatatttttttatattggggtggtggttgttttttgagacagggtcttgctctgttatccaggctggagtacagtggcacagtcacagctcactgcagccgtgaactcctgggctcaaacaatcctcccatctcagccccctgagtagctgggtctacaggcgcataccaccatgcacagctaatttttagttttttgtagagatggggtttcactctgttgcccagtctggtcttgatctcctggcctcaagcaaaatcctcttgccttggcctccaaaagtgctgggattacaagcatgagccactactcccagccatattgagtttttttgttttgttttgtttttgtttttgttttttttacctctcgtgtctgctctgtagggactgattattaattttgtgggttgtccctcttgatgtgtttcgattctaacatttcactgcctttagcatctcagcatggcagtaaacaccaaagatcccatccaggtactgactttggtcacacctgagcagttctgcttagaggcttcatgggaggtgaatgagaagctgcttactaaaatgtccttggcatcatctgtttcttctccagacagactctggattccctgtggtctccctatagtacagtgtcacctggctgtacccaagcccagatttgattgacaactttgttgcttgttgcagtggcagcaggatagtgaagcatgagctaatggccagggcaggctttgctgctctctgtttgttgcctggtgggggctggtgtttgtctctcttttttatttttttgatatgacgatttttacaaaatttattatgttgttggggtctgtggtttttgttttaatttgctttaattaaataaaagtcctctaaggcagatggaatgtgtacaatgtcagaaagactagctggcagaaaggaatgcttttctggtcagagtgtgtgtgccttacaagggggtgtgtgctctctcccgtcccttctccacagactggcaagcgtgtgggcaaggtactgcatgcctccttgcagagtgttgtgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtctggtttggtatgtctagagttcttcagttgaagccaaggcaccattcagtgacccatctgggtctggcccttatctagtgagtggcagacaaatccagagctctgccaccaagggagacccccacaagctggagtaaagacctgacagaaactggtttacaggaaatgcttatgatatgtattttgtgaatttttttccccttgaagaactttaaaaataagaatcacaaagaaaagttcattcaccttgtgtatttgggtggttctgggagaggaaaaaagaggaggcactctgctgcaggtacacacccagggcgtctgtctgtctggttagccatcccaaatcctgggaaagtccagctctgacttcctgccctccaagagatccgaatggaattccctaggttcaggggctttagtggcagccactttggcccttagccatcctttcttatcactcttgttttgaaattgctttgtgttttataaccactccctggtgtttcctaagattttgttttgtcagcattaagaaggcagctttcaagatgttgtcatttgataattcagctgccttcatgctctcagcattgaaaggaagactatgcttgctggcccagaaggctcttcctataagcctgtagtctcactgtgcagtgtgttaaaattaagtctcttcatgtgtagagcagcctttgtttttttttctaggggaactgaaactcctaaatcttaaaacaccctggggaaggagctgattcacgaaggagagcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagatgcaactcgagtgtgaataaagtttagaagcatttgcttttgatggtt

SEQ ID NO: 8879 - DNA, 129 bp, Homo sapiens
accacacctgggtaattttttttattttattagagacagggtttcaccatgttggccaggatggtcttgatctcctgaccttgtgatccgcctgcctcggcctcccaatgtgctgggattacaagcgtg

SEQ ID NO: 8880 - DNA, 2163 bp, Homo sapiens
gtattaactcagaggaattgggcaatgtctagcaaaattaaatatgcatatacctttaattaagcaatcacacttttgggaatatatcccaaaggcaaatttgcaaaaaatataaaagaacatatctgtaaagtcattctttgtgcctttatttgtaatagcaaaagattggaaagaacacaaatggccatctctatggaaaaaacactcaaagtgctttttctgttctctcacccagcaacaatcaacacagtagacttctgtgaaatgtgtggggttttttccccagacaccaagcaagtgttaacctgaaataatcgaaagaatcagagtctagctttattcaagtgaaaagctgagaatggccatctgggaaacacaaactccagagaaatggagtctgtgctcccaaattaaaagttaagttcttgcttatacaggcagaaaacaaatgtattagggttatagcattttctatgcaaggctggtttatgagttataacaatctaatgagttacagcttgctttcatttccttttcaatttaaaagagtgtttttaacatttcatcttagacatgatagtctgtgtatgaaaaaagtaaaagggcagttaatctacagtgaagagagaatggggctgcctaggtgccctttaatcatttacaacattttataaaactatgtgggtaagagagaaggcaaatctaatcagagaaacagtggttacagttccctgttacgtgactgaggtcctataatcacattcctttaaggctcaaaatgttttgaagttccaacagcttagattttgaattacttattttcacacaatcagttctccagcagacagtagctgagtatcctctaattcagttcaattctgacactgcctggagacagtgtgagatctcacaggttgagggatcccacttctgatgccatttgcaaaccccaggttagtttgcctgtgcttctgactgaccggctataaactggggatcccacaaccccctccttggattcgattaatttactaaagcagctcacagaactcagggaagcatgtttactagcgtattataaaggacataacaaaggatacagaggaagagatgcatggggtgaggtatgggggaaggatagagcttccatgtcatttctaggtgagccacactccaggaaacttcatgtcttcagctatctggaagcttcccaaaccctgtccttttgggtttttatggaggcttcattacataggcatgattgattaattggccattggtgatcaacttaaccttcagccgctctccctatctggatctttctaatcatgccttgatctttctgcatgaccagcccacatcctgaagctacctacaggctgccagccatcagtcaactcattagaaagacatcactttagagagtccaaggattttaagagctgtatatcaggaaatgggtcaaagaccaaatatgtattttgtaatattacatcatcagtaaagcagttctgtgcaaccttaaaaaggagaataaagatgatctttatgtggtaatgtggtatgattttcaagaatattattaagaaaacaagatagcacttaatatgtagcacatgatatataggtttatagcataaactatataaaagcactgctaccttttatataagaagaagagacatgcatataatctaaatgttttcatataattttgaaaagaaacactggaagaataaatcaaaagcaaatatagttaccttttcggcagaggaaagggattagaagtgagactttgaattttcattttattttatttatatattttttcgagacagggtctggctctgtcacccaggctagagtgagggcagtggcacagtctctgcagcatctgcctcctggcctcaagccatcctcctacttcagcctcccaagtagctaggactacaggtgcacaccaccacgcctggctaatttttgtagagatggggttttgccatgttgtccaggctggtctcaaactcctggactcaagaaatccaccctcctcagtctcccaaagtgctgggattataggtgtgagacaccatacccagacagaatatgtttttaaaatattttgacttggaatcatccacatatttagccttcaaagaa

SEQ ID NO: 8881 - DNA, 544 bp, Homo sapiens
caccatatccaccaccaccagagctaccaccaaagccaccatgaccactaaagtttccaccacaaccaaaattgccattcccaccaaaaccacctccacaaccaccaccaaagtttccagaagcacttcacccttttcggctagatgaagcactaggcatctcttgatttgacacagcttccctaatttcacaattgtggccattcacagtatggtatttcagaatgacagtcttatccacagtcatgcttacaaaggcaaagccttttttcttgccattgccttggtcagtcatgatttcaatcacttcagtttttccatactgtttaaaataatctcttaggtgatgttcttcagtatactctttaatgccagcaacaaatatctttttcacagttaagtgggcactggtctctgagagtcttctcttgagacagctctctttggttccacaactcttccatccaccttgtgtagctttgcattcatgactgcatctacctcctccacagtggcatacgtgacaaacccaaagcccctggag

SEQ ID NO: 8882 - DNA, 4557 bp, Homo sapiens
ttttttttttttttttgccatcatcaacacttatttaaaaagtactttaaaatcattcattttctgaaaatgcttttcattattttccagggtccataaaaagcatagcacggggacgaaaagcttttctaagccagcagtgtttggtgaacactaacaatcccactggcataaagttaaagttttatttccttttttcttttcttcttaaaataaaattaaggctcaaatgttctattaagctctcattgcttatgtatattatattaaggcttataaatgcacctggtaaattaaattcaccctggattgaattaacacctgctatatgagttatttgctttatgtaatcagtaatctcaaggtttctcctctttctctggaaacacaatttaaatattaacctaatctttaaactgcggctgcttctttctgacatttggaaactggtcatccatacaaaaaaggcaaatatggatatattaatgaaaaggcagcttctcaaaaatcttaaagtatgtaactcaatgaattgggaaggaaaatgataaaagtagcaggaaagtcaagtctttgtgtcactttctagggaaaacaatgctggtcatctgccaacaacacctccagtctgagagcctggctgaagttgactgccaattgccaaagagtctttgggttttcttcatttgaatctctggaagaaccttgggaagctgccatgcgtgcaagagaattttaattttaaaaaatgcagtaaggtataacaagttccagggatgataaatcctgcagaaagacccatgagggtgtgtggtgcacttggcctgatccggtcccaacgtgcagccagggagagggactacgggcctcctcaagtcctgctcagctgacagcctctggagaatacgaagctttcaaagtgctggtcctcggctttttctctgatgcgttgttcctctaaggaatcgacgagtttgtccctttgctcaatcacttgcatcagctcggtgaatacttcttgctcttcgtttagatccttctcatctttctggctctctaaagaaaaaaaagaaaaccactgggctcagagaagattgggccccggcagagttcttggcatggacattctcgattgttatggacttgttctgcctttaattttaatggagaaaacaaggaaatgaatttaacaccaaggaaccgcccttagagtgagagatgagaaaggtgtgtgcggtgaaacagttcactcagttttcatcttgaagatatgtacaaagcgacagggaaaacccctttgtaagaaaaggaatttaataccagccaaaccctatcaaatcccccaaccttccctctgccccaaagagaagctaacaaaacaacaaaaaaggcggtttccataaacatagctgagccacagcaaagaaatctgtgagaagtttctaagtaaaccacctgcaccagtggctactgtttcaatgaccacaatcttttttttcttttttctttttttgagatggagtctcactctgttgcccaggctggagtgcagtggcatgatcttggctctctgcaacctccacctcctgggttcatgtgattctcctgcctcagcctcctgagtagctgggattacaggtgtctcccaccacgcctggccaattttttgtgtttttagtagagacggggtttcaccatgttggccagggtggtctcaaactcctgacctagtgatcagcccacctaagcctcccaaagtgctgggattacaggcatgaaccacagcgcccagccagaatctttttcatgtgtagttaatgacaaactagccttttgtttagggaccacagggaagcaaagtgaggctacaactgtctgataggaaggtgtttccacactgactttgcttttccctttgtcttctcgagtacctgaccttcttgataattggcctgaggcatttggttgcctgggggagataggattgttagaaaatgaaaggacagagtaggaaacaagtagtaatgagctttggacacagaaaacaggattctgaagccagatttaagtcttgtcaagcagacaattgccttgggagaagactttctaaattcctagagcccctgtgtctaacacacggaggactgggtggggagcctcctcccagagtagagagggtgccacttccttcatcaggcttagctctgaggtctgggccaggaagcaggtaggtctgatgaaagggagacaaagaaacaccatcccactgcacctcaagttttaagaagaaagaagagaggcaggaggggcagagggttagagccccatgctcggtctctccattctgggccttagaagccccaaaggggacaggtaatgtcatatctcattggtggatgggcaaaggactcttgccctgcccttgttcagaattctggaaagaagccagcttaaagggcatccctatgtataaacataagacagtacttcatggttgggcagagaagaagggtctgagtgtggccccccagatcttggtgtgctgtatgcggcatgggcggagcctagaagggtccacttgccccactgttaccagagacagctggctagtggacctgccacagggttcccccatggggcagagtgaccccacaggagagactgtctagccatgctgaatgaaggatgtgctgaggtgaggctgggtgagccaggaatgcccgcaggctctcaggcaccccgagagagtgggcaggctacggatgagaccagcacacacctcagttgcagatgccaccagagagagttgcagcccaatgatgggggatgccatgaggggactcaataagcacagcaccccacacagagtcctaatgccaccacaaggtcacacagacctgccttttcccattacttgccagtcaccctggggagagacagagaagggaggggtggcatcttcaagactgcacattttcatcccaaagagaccgagcatctcctacacggattgtttaagttattgcatcagattaagtttaccatggaggggtaaagagttcctattttttttccttgctaatcagtgggaggatgcataggcagaagatgagctcaggtacagacagaataaagaaactacattttttggatacatctgacagggttgagaaaaacctatgaccttcacttcttagtaagaatttttttaaaaagaatcaaaggtggcaaatagtctttggtggtatttatttagtatcctgaaacagaacaaattaaacttttcaaatctgatatataaatcagatatcagttagaacctatggtttattaagttaggtatattccaggattactattcatttaataaacagcacagaaaaataaaaaaaaaatcctctctcagtttaggcttgtcgtggatggacccatctgagcccctctgacatataaaaaatgatttataccactttagtctgtacagtgctgctgcataaggattttgttagaattctgttgctataaagaaacagtctgcaaattactgccatatgggaaagaacaggagaccctgatctgtgatctgttcctaaatcttagccctaccattcaccttgagcatgggatttaaattctctgagactcagttttctaatttgtaaattgggcgcgaaaatacctaaatacaaatcagtgataataatgcctaacatttgctcagtacttgccctatactgggcaacctcataaggtaggtgcagtattagatccctgaggtatagacattctttaagttgttcttttagatctaggtctgaatatgggaaggtcatgcatcgatctggcactgcaaacacacaggtgcaaaacggagtgaatatgcctttctggcaggaactaataaatgcatacagcagtatactgtgtcagttgagtttatctctactctccttgcttcctggtggaatcgttttctcatgtgtgatgccctggccctgcccacgctgggagggaacgtttcctttactagctctagtgcctggcagcactaggcccgcctttctctgggatcccaaagcccttctgatgtggccttcatctcactgaactagcattacggaactgggggtgttagtctccccagtgagaccacaaactcctagagggcaggacttgctcttcatcataaaccaggaccatagttcccagtaaatgtgtgttaaatgaatgggtggatacatgaatgaataagtgaacataggactttgttcctactgccacttgggatgggggaaagcactgccctcacagcccaagtgaatgaggctaaatggggcttgtggtgctgctggtgggaggcaggctggctttgtactttcctctaacttgcaggctggcaggcaggaagagcgccccactctgggatttgtggcacacgctgctcaggagcctttctagggggaagttctcaacaaaggcccaagcatactcaccctccttgagcattttctctctcagtttctgctccagtctgctttgatgatcttctaattccag

SEQ ID NO: 8883 - DNA, 739 bp, Homo sapiens
aaaaaaaaggaaggaaggaaagaaaaggaaaaagaactgcaacctttggaacttgctataacatagaaagattgtgcttaaatgtaacccaaagcattggctgactcagaggaaatccagttatacatctaatttctggcttgtgagctggccagattggtgcgtgcagagagcgtctctgacagaagtggtttatggattgatttgagagaaatttggtctccagtcagagccaactgttgcagagcaccttttgtctaatgacacatttaaacacttgccgaaatgagagcggccaaatacacaaccaagagttctttagtgtttctcttatcgataatagactaaatcttcaaagaatccgagcaaaaacaatcaaatgttttatgacaacacatcaccatattaaatcttctcttctttggcccccatgggaaccctcataatgccccaggaattccaacatgtcagcacacaaactccatcttccagctttcttttcaaactgaaatgtcattaaaaaaattcatgacccagtttgggatttggtaaatagggtcactgcattcagccctccctctaagtcagaagtggttttgtccttgctctgtagagttcctggggagagggagagatacttctctctttgagtctaagaagaccaccagcgagaagcattccttctcttgtaccctagtgtgttcagtttcagtagcggcaccaacctcaccaatatttt

SEQ ID NO: 8884 - DNA, 14273 bp, Homo sapiens
ggtagccgcagctgtcttttccggcccccgtgcactctccgcccgagcggagccccccggctcgcggggatcgcccccgagcgctgcgtcctgcgggtgggtgagtgagcgcctcgcggcccccgagctgtggggtgcacctggccggggagaaggatatcttggctcccttgcaccccaacgggcgcaaaggggcaggagcccggattgggggaggaggaggacccggggaccttgtgtcgctcggtgggagccggtctgtgtttctgtttcgctagggtgtgtttgggttggtagagtttgtggggaggggtgcctcgtgtggatgggaggaatcggggaggctaaggcgaggaggagggggtttgagatgggttgagggagaggattgacggagggtggggttttgaaagagttggaagtttcttgttacctgtgggtgcggtgattgcattggggggcttggtaggggcagctcaggacaccgaaggagaggatggggaaggctctcctgcccgtaacttacttcccttttgggagatttggttcctcttgcattgctagttaaggaaggagaggctggagaagcctgtgccgtcagagaacctttgcccctttccagaaccggtgccatccctagtctcaggaacataagggaaggggtggcccccaggagccgggaggggccttgaaacccctgctgacaggtttggggtaccacttttttgtggggcagtggctggtaccatttgcagcccacggacttttttgagttgccggtaagcagggtgtgggtgcgttcctgtttccttgcggttgtctctttttttttttttattgacacagggtctcgctctgtcacccaggctggagtgcagtggcatgatctcggctcgctgcagccctacgcctccaggactcaagcgattctcgtgtctcagcctcccaagtagctgtgattacaggcatgcaccttcacgcttggctaatttttttttttttcttgtgagacggagtctcactctgtcacccaggctggagtgcagtggtgtgatgtcggctcactgcaacctctgcctcctgggttcaagggattctcctgcctcagcctcccaagtagctgggactacaggcatgagccaccatgcccagctactttttgtatttttagtagagacggggtttcaccatgttgaccagggtggtctcgaactcctgacctcaggtgatccacctgcctcgtcctcccaaagtgctgggattacaggcatgaaccaccgagcctggccaatttttgtatttttagtagagagcagctctgtcttttggggaggcttcagggtgtttgattagtggtctttgggggtgggcgagctctgtgggggagcttttgatgcaacataatctcctttgcaggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattggtgagtgggtcctggggcgggtgtggactgactatagtatgggaggacatgatggggaggggtggagatgggactgggataagattaggaaggggacccaagagaagcggttggctgaagggtttggggaggggctctctgtgggcttgcatttagctccaccctggagctctgcagaaccagggggtgggggatatggggtgtgagtcccctgtgacctgatttgctgctcctgcctcagggttcgtggtgggtcatgctgggctactgcaggccctggccatgctgctggttgcctacttcatcctggcactcaccgtcctctctgtctgtgccatcgccaccaatggagccgtgcaggggggcggagcctactgtatcctccaacatcgatggactggggtctggcctgttctgcctgctagggagggtgtggaaggggccattacctttgttggctcaggggcaagacaagtgtttttttcattcttaaaatttttttaggctgggtgcggtggctcacatctgtaatcccagcactttgggaggctgaggtgggtggatcacttgaggccaggagttcaagaccagcctggccaacatagtgaaaccccgactccactaaaattacaaaaattagctgggcatgatggcacccgcctgtgattccagctactcgggaggctgaggcacgagaatcgcttgaacctgggaggtggaggttgcagcgtgccaagatcgcatcactgcactccaacctgggcaacagagcaagactctgactcccaggctgcagtgcagtggcgccatcatagctcactgtgatctcgacttcctgggctcaagtgatcctcctatctcagcctcctgagtagccagcactataggcatgtaccaccacccctgtttaatttttaaatatttgtagagatggaatcttgctatgtttcccaggctggtcttgaattcctggcctcaagtgatcctcctgcctcagcctcccaaaatgctaggattacaggcgtcagccactgtgcctggcctggcagggcaagttttaataaatgtgcagcaggcaggctggtatagtgaaggagatcaacattgccctgcacgttgatgccaatttctagtccaacaatctcatctgttaggcagtgattgttttacagatgcagaaactggcactcagaggatatgagtgacttgggcaaagccacatggctggggcctggctgcacttgggttcagtgcttggagctatggcaacttcctcacgtccatttcagtcttttcccttaatgctcacccctgcttccactttcagtcatgatcagccgcacactggggcccgaggtcgggggcagcattgggctcatgttctacctggctaacgtctgtggctgtgccgtctccctcctggggctggtggagtctgtgcttgatgtcttcggggccggtctgtgctctgtccgatctgggcagtgctgcgggtttacagggtctgggagtgtgggatcatgagggagaaggtcctctccagcagaggggcagactgagccattaccttggctttctggagcttctgctgtgtggccagcatcgtgcaggagatatggacatccctgagattgtccttgcctgcagggagctaaccatctaatcggagagaccaggctaagattcttaaaactgacagagaccaccagggagagctaagatgctaggatggagctaagagggaagtggggaaggtggactctctgatagcaggtgggcagaggagggcttgtcttgctttgggtcacagttggggctgggtcccttcttatttatttatttattttgagatggagtcttgctttgttgcccaggctggagtacagtggtgtgatctccgctcactgcaacctttgcctcccgggttcaagcaattctcctgccttagcctcttgagtagctgggattacaggcactcaccaccacgcctggctaatgtttgtatttttagtagagacggggtttcaccatgttggccaggctggtcttgaactcctgacctcaagtgatccacctgcctcagcttcccaaagtgttgggattacaggcgtgagccccggcgccctgccccttcttcttttttttttttttcttgagagaaggtctcactctgtcaccaaggctggagtgcagtggtaccatctcggctcaatgcaacttctgcctcccgggctcatgcgattctcccacctcagcctcccagtagctggactacaggcatgcctccccacacctggctaattttgcagtttttgtggagctggggtttcacaatgttgcccaggttagttttaaactcctggactcaagcaatcctcccacctcggcctcccaaagtgctggaattatagatgtgagccgcccaccatgcccggctggtggggtgccttaggatcgggccttctaactctgtccctacctctctccagatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcggtgagctgggtgctgccgtggcagggatctcggggtgaggggtgggcagacgtcgggccgggcccgtaaaacctctggatgagcacaggtgtcagagggaatggagggcaggaggtctggactgcagagcagtgcaatttaattcaagcctgtctagcgtgtgcttggccggcagggcaggaggaagcccacaaaacagtccctgctttagaggaacttgtgttctagctgaggagagacatgcattcaggaatcagttaaatagcacagaatggcccagcatgacttaaacagatcaggatcacccaggagtggagagaagggaggcctgactatgggctggggagggcaggagccggggagctggaggtggcctgagatagacaggtgggggattcagccaggagctgggagcagagagggaaggcatctcaggaaagagcttgagaccaggtgcggtggctcacgcctgtaatcccagcattctgggaggccgaggcaggaggatcacctgaggtcaggagtttgagaccagtctggccaacatggtgaaaccctctccccgtctctactaaaaacacgaaaattagctgggcacgctggcttgcacctgtagtgccagacactcgggaagctgagggagaactgattgaacccgggaggaggagccgagattgtgccattcagtgagccgagattgcaccattgcactccagcctgggagacagtgaggttccctctccaaaaaacaaacaaacaaaaaaaacaccataaaataaaaatacaaaaattagccaggggtggtggtgcgcacctgtagtcccagctactcaggaggctgaggcatgagaatctcttgaacccgggaggcagaggctgcagtgagctaagatcgccaccactgccctccagcctgggcttcagaacgagactccgtctcaaaaaaataaataggctgggtgcggtggctcccgcctgtaatcccaggactttcggaggtcgaggcgggtggatcacctgagtccaggagttcgagatcagcctggccaacatggtgaaaccccatctctactaaaaatacaaaaattagccaggcgtggtggcgggcacctgtaatcccagctacctgagaggctgagacaggggaattgcttgaacctgggaggcagaagttgcagtgagccgagatcgcaccactgcactctcgcctgggtgacacagcgagactccatctcaaaataaataaataaataaaattaaaaagttagatgggcatggtggtgcacacctgtagtcccagctacttggcagactgaggcaggaggatcgctctagcccaggaggtagaggttgcagtgagctacgatggtgccactgcactccagcctggatgacagagccagaccctgtctctaaaaaataaataaataaataaaagagcgtggattagggtctggagggaggaatatcggagcactggggggacgtggcaatgtgtctggctgacccagggccagtgcaggaacaggctggggtcttagtgagggcagtgcaggggaggcaagaggaccgtgggaatgtgtggagagggtggctaagaggcctggatccctgagacggatgctgatgcactctcctccctgggaggatcctcctagctggctatgctgaggactacaccacgggagccgtgatgaattttgccagcgtctttgctgtcctctttaacggctgtacaggcatcatggctggggccaacatgtcaggtgagagtccctgcctgctgcctcctgggggtttggggctgccaccgtgagggacccagggggatggctggagggctgacctcactccctctgctccccctctccaggggagctgaaggaccccagccgggcgatccctctgggcacgatcgtcgccgtcgcctacaccttcttcgtctatgtcctgcttttctttctctccagcttcacttgtgacaggtgtctggggagggatgggggtggagtgtcgaacaagattggtgcacctgggtcaccaaggggaaacacaggctgggggactgggaagcagaaacccagcttgttggggtggagggtggctaccggcgattgacaacctatagccagcagctgccatggacccagtactgttgcaggcacttagcttgggagtgagggtgggtagtggctttctacccagtttgcatttccacaaatatttggcctcttgtgcatataccattaggtatgacagccgggtgcggtggctcacacctgtaatcccagcactttgggaggctgaggcaggaggatcgctggagcccaggagttccagaccagcctgggcaacagagcaagagcctccccccaaatacaaaaattagccaggtgtgatggcaaatgcttgtagtcttggctacttgggaggctgaggtgggaggattgcttgagtccaagaggtcgaggctgcagtgagctatgattacagcactgcactttagcctgggggttggagtgagaccttgtctcttaaaaaaaaggaaggaatgaccactgagtgattaaatccaaggctgcccaatgaataccaggcatatccctttagcacatttgatatctgagtctgatccttaagatcggggctggagattttcttaccccgtgacgcatgatcatccgtgtcctccttttcctccttcctaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggtgggttctctgcctccttgctggcttggagcacgccctcccttgtctgtctctccgtccccgctgagccctggctgatgtgtctgctgtggattctgtttttctaggcgtgatcttggcaccggccaaggttgtgtcccgagggggaaacccctgggcagctgtactttattcttggggcctggtgcaggtgagccttcttcttcaaggggccctttccctcaccccaccagctggcaggatgggggtgcagttagatgcaggctgggagacaaatgtaaagacaaatgcgtatgcacttggggttgcactggcactctgcagggttcactggcactttgtggggttcaccagcaccttgcaggttgccccagtgctttgcagagttcattggcaccctgggaggttcactggcactttttggggtacacgggcattgtgcagggttcactgacactttttggggtatactagtatttttcagtattcactggcactttgtggggtgccccagcactttgagggattcactggcactctgtgggatgtaccaacactttgtgggggttcactgatactttggaggtttggtggcactctgtgggagtgcattggccctttctggggatcactgacattgggggtgcacttgcactttacagggctcacgggcacttttcagggttcattgacactttggggtgcactggcactctctggggttcattgacactttgggggtgcgctggcactttgcatggttcactggtactttccagggttcactgacactttgggggtacactggcactttctggggttcactgacactggggatacactggcacttttggggtttaatagcattttaggggctcattgacactttgggggtgcactggcacttttggggtttaatagcattttgggggttcattgacactttgggggtgcactggcactttgcagggttcactggcactttctggggctcattgacactttggggtacactggcattctttggtgttcactggcattttgggggtgcactggcactttggaacaacggcacgcctcttggcccttgcccagctggtgctcctggctgggaagctgaacacactggctgctgtggtcactgtcttctacctggtggcctatgctgccgtggacctgtcctgcctgagcctggagtgggcctcggcccccaacttccggtgagagactcagatctgtgtccccagagagaagaagggaggactcgggctcaggcgtggggctggggactgcagcctcgtgtgcggcctgccctgagtttctgtccctcctcccctccatgcccgcagccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtatggggagctggtggggcggtggggaaatgggaggtggtcaaagaaccccctctctctttggctggagttggtgctcccgtccaggaggcgctgaacggggctgtgcatttgatcctgccacttccccactgcctcacccctatacccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcggtgagctgccctcccactcactcactcactcccatccttctctccccctaccttttttttttttttgagatggagcttcgttctgttgcccaggctggagtgcagtgggacgatcttggctcactgcaacctccacctcccaggttcaagtaattctcctgccttagcctcctgagctgggattacaggcacacaccatcatgcctggctagtttttgtatttttagtagagaaggggtttcaccatgttggccaagctagtctcgaactcctgacctcaagtgctccgcccatctcggcctcccaaagtgctggaattgtaggtgtgagccaccacggccagaacccctcccccgcttttttttgagacaaggtcttgctctgtcacccaggctggagagcagtggtgccatcatagttcactgcagcctcaacctcttgggctcaagtaatcctcctgccttggcctcctgagtagctgggactacaggtgtgtgccaccaggcctggctcatttgtagagatgaggtctctttatgtttcccaggctgtctggaactcctggctcaagcagccctcccaccttggcttcccaaagggcagggattacaggcatgagccccgacaccagcccctctgccccttttatcctttcccatgacccctccaagtagccatagccctgcccaggcccgtctgtgatttggactctaggagacattgagtttggacaacactggctaccttcctttccttatcttctctgtagactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtgagctgcttctccctggatgccctcggccttcctctgtggccacttcaaatctccgctcccctcccctagagagtcagccacagattgcaaactgcaaaaggaccttatagtcgagaggagataagacagtgctcaaagataatagcctcagacagtgtgtgataaggtctaataggagatgctagggactagtgatggggtgggcgatgttgtgggttttttttccttcttcttttttttttttttttttgagacggagtctcactctgtcttgcccaggctggagtacagtggcacgatcttggctcactgcctcctccacctcccaggttcaagtgattctcctgtcttagcctcccaaatatctgggactataggcatgtgctaccatacctggctaatttttgtatttttagtagagatgggggtttcaccatgttgcccaggccagtgtcgagctcctgacctcaggtgatctacccgcctcggcctcccaaagtgctgggattacaggcatgtaccactgtgcccagcctttccttctttttttttctgatccaaaaattggggcataggcactgaagagtgtatttttggagacaatggagcattatttgaatctccagctgcctcatcaaatcagatggtttttaaccaccagtgttcagaggaaggcaggccagccactatacactgatgtggccagcaaaggttttgcggagagatggtaattcatccagactttgaaagaggttgggatgtaggagatgtaacatgtctcccctgcccccgccacccaaagccacaaaggatgccggaggctgtgtggggcggacgtctgtggatggagcggtaaattctcagcttttagcgctgaggccaccagggttatctatgctcagtcactgccttttcccttaatcctggaccagtgcccgtcaccaaagtgcatgcttccttctctattcagagtctggctaaagttcaacagtgttggacattgcccagttcagtgtaaatcagaaccctgggaaatactgaggagggggcatgactagtttattttgcaagatcagctggaattcacacctgcggagatgttttggggtgtcgtcaagcatcattgacccacagaacatctgagagcctggtcttcactttttgtgcagagaccacaatgcttatgaaatacgaaatttttcctgtggaagatatcaggtcggtgcaaaagcaattgcggtttttgcctttttttttttttttttttggacagggtctcactctgttgcccaggctggagtgcagtggcacaatgtcagctcactgcaacctctgcctcccgggttcaagtattctcccatctcagcctcccaagtagctgggactacagatatacgccagcattgtccggctaatttttgtatatttttggtagagacggggtttcaccatattgcccaggctgatctcgaacttccaacctcaggtgatccgcctgcctcagcctcccaaagtgctgggatgccattttaatgggggaaaaaaagaaccacaattacttttgcaccaacctattccaataaaaggaaaagtagttcctttaaatggtggattctcctgtcatagaaaatttgatttatggcttgagcagtgtttgtttcatgagaaggggtcttggaagaggtctctgcgtctccctgtaaactcagcaattatccgattccacaagggttgttcaaaaattaagaacgaagagcttgtcagcagggacttggagcattgtggttgccacgtgcccagctcggtggctcagagtgtggcctctcacgctggatggaggcggattgcgttgacctacctgccccagtacctaccagatatgagcctatgggcaagtgacttcatcccttggtgctttgggctccttatcagtaaaaagaggagactaaatattacctacctcatagcattacttcgagtttcaaataagttaaaatataaagtgctttctacaggacatagcccctggtaagcggataccatgcaatgaaccaccatgattagggttttggtaaaacctactagggttagggtttactgcagtaaacatacggggtagccctgtttctttttttctttttttttgagatggagtctcgctctgttgcccaggctggagtgcagtggcgtgatctcggcttactacaaccaccaccttccgggttcaggcaattctcatgtctcagcctcctgagtagctgggattatagatgcccaccacaatgcccggctaatttttgtatttttagtagagatagcatttcaccgtattggccaggctggtctcaaactcctgatctcaggtgatcaacgtgcctcagcttcccaagatgctgcgattacaggtgtgagccacggtgccctgcctggtccattttttcatcttcccattgcagagtctgggacgctattaccctggggattcaggtcatgagcttggctgatcagggtgtctggtttgcacaacagagtcaaactcgcatcccctgccgtgaaacagatgccccgctagaagccgggagtggacagcatcctcctctccatagaattggagtgctcattagtggcaagaatcctaaggcgaactttgcctgtttaagtggaggagattagtcactgagataataaaataaatgcatgtgaaagtgtttaggaaaaatgaaaagtctttatgcaaatatgcagaatgttgccgtaagagcccgtacacagtgggaatgtcatacctatggctgacgcaccttgctgtcagtgtgtgggagcgtggtgtaaacttagcctgtgagcctgactcctgtctgttcctgccttccccgctctgcccccaggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacactaca

SEQ ID NO: 8885 - DNA, 6198 bp, Homo sapiens
aatgtggtgacgtcatcggaggcgtggtcgtccccaaaattagggaggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggtaaggcagcccttgtgagacagaagagccacccagctgtggcgctcacctctgtcctaccgctccagcctcccgccctggctgcttcctcctgccccttccccaagccgaggcggggggaacagccgcctgcgctctcttgggaccctagatttgggggaggaggtaacgagaggcggagagggtggctcctcaaatatacacccctcctgtcctccgccaccccacctttgatttctcttccctcaacccagcactccagccccaccccagggtcaatttttgcccccttccatctgagcagtgttaccaggccccagggggaccggaggatcgggggccggcgtgggtggggtcccatggagtactccagcacacgcaggtgagacccgggatcgtggggtgggacatgtgggatcccccagaaccgagtctgagggacccaggacaggagaaggcctatggtgatttgcattcttcctgccctggctccatcctcaggggctccctgcagacagggggggccttcgccctggaagcctggacgccgagatagacttgctgagcagcacgctggccgagctgaatgggggtcggggtcatgcgtcacggcgaccagaccgacaggtgactctgcccctcctccccgtcagcaccctgcccccttctctggactctcagacccagcctgatcgatcccccatgtgtgtaatgtgcaccccagcatggaggaagcgtggctgcaagtaccaacatgtcagccacttgaggacgggaccttgtcaaatgcaaaaagcctgtgcttccccacagccagggtcatttccacaaatgtgggtcttggagtggggtccttgcttacgacttctggcctgcgtttctcctcaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgagccctggggaactgggatttcaggccctacagacaatgggacaccgactgggtggggtggctggtggtgttttagggggcttttttgttttttgagacagagttttgctcttgtttgcccaggctggggtgcagtggtgccatcttggctcactgcaacctctgcctcccgggttcaagtgattctcctgcctcagcctcctgaataactggattacaggcacacgctgccacgcttggttaatttttgtatttttagtacagacggggtttcactaaaaccccagtttgttggccaggctggtctcgaactcccgacctcaggtgatccgcctgcctcagcctcccaaagtgctgggattgcaggcctgagccaccgcgcctggccaaggggctggttttggagcagagtcagaggtctgggacgtggaataggtaagggcagggcagtgcgggggagcaggatagaactgcccattggggctgagcgcggtggctcatgcctgtaatcccagcactttgggaggctgaggtgggtggatcacctgaggtcacgagttcgagaccacactgaccaacatggagaaacctcgtctctactaaaaatacaaaattagccaggcatggtggcacatgcctgtaatcccagctactcgggaggttgaggcaggagaatcacttgaacctgggaggtggaggttgcggtgagccgagatcgcaccactgctctccaacctgggcaacaagagcaaaactctgtctcaaaaaaaaaaaaaaaaaaaaaaaagaactgcctacgggcccctgggctgagatgttctcagatgagctttctagctggaactgcctggccaccttcagagacattatagcagtccccaatctttttggcaccagggaccagttttggggaaaacaatttttccatggactggggagggggatgggagggggtgggagggggatggtttcaggatgattcaagcacattacattcattgtgcactttatttctgttataataataatagaatatatagtatatataattgtttcggtatatattacaatgtatattacaatgtaatatataccgaaacaattatacaattcaccatcatgtaggatcagtgggagccctgagcttgttttcctgcaactggacagtcccatctgggggtgatgggagacagtgacagatcatcaggcattagattctcataaggagcttgcaacctacatccttcgaacacacagttcacaatagggttcatgctcctatgagaatctaacgccgctgctgatctgacaggaggtggagctcaggcggtaatgcaagtgatggggagcagctgtaaatacagatgaagctttgcttgcccattgctcagctcctgctgtgtggcccagttcctaacaggccatggcctggcggctgagggccctggtattacagcatcaggagctagagtaggaccgagcccgattcccaccttccaggtgcccctgagccagcctccagaggatgagctggataggctgacgaagaagctggttcacgacatgaaccacccgcccagcggggagtactttggtgagctgaggctgtggggtgggtgggacgtgggaagggaggctgggagacagaggggacagtggcttcctgggtctgtgaagactgatgctgtttctccctgtcctcaggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggtgagtggctggggctgggaggagggagtcagtggctggatgcagggggcttccatccaaggtggtaactagagcgtccaagaccaaaggaggaacggtgctaaaagccaggcgactgaaagtgatgtacaaacagggcggaattctgcaagtatcaagcaagtagcttaacactggtggctgaagggaaggacgcagctcttacaagtgtggagcatcttacagttaaagagaatgtgttagattcccatgacacccctgtgaggcaggtattactactgattcctggttttgttttttgtttttttttgagacagtctcgctctgttgcgcagactggagtgcagtggggtgatctctgctcactgcaacctcagcctgccctggttcaagcgattctcatgcctcaggctcccgagcagttgggattacaggtgcccaccaccacacccagctaatttttgtatttttagtagagacagggtttcgccatgttggccaggctgttttgaaactcctggcctcaagcagtccgcccactctggcctcccaaagtgctggcattacaggcgtgagccactgcacccagcctgattcctgtttttctcatagtgtttaaataccgtgtatagtgctgggacctgaactcagatctgctcaagtctgcctttcaccgaatcacatgcaggaggctgcatgcaggaggctgcagaaattagatggctgggttgctggggttcctgttgagctgccatggctcccgcccgctcccagatcttcctgccttccttcccaacaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggtcaggcctggcctccaccttgtctcacaatgtctgacctttcctgtctctctcatctcttcatgccccaggactgtctcttcctgtttccaaccctggccctccttcgttctttgttattgttattttttagagacggagtttcactctgttgcccaggcaggagtgcaatggcatgatcatagctcactgcagcctccaactcctgggctcaagtgatcctcctacctcagcctcctgagtagctgggactacgggtgcacacgccaccatgcctggctagttttcttcgtttttttttttttttttttgagatggagtctcactctgtcacccaggctggagtgcagtggcacgatctcagctcactgcaacctccaccacctgggttcaagtgatttgcctgcctcaacctccccagtagctgggattacgggcgcatgccaccacgcctggctagtttttttttttttttttttttttgtatttttagtagagacaggctttcatcatgttggccaggctggtctcaaactcctgagctcaagcgatccacctgcctcggccgcccaaagtgcagggatagcaggcgtaagccactgcacccagtcttcttctttgtattttaataaagacagcgtcttgctgtgttgcctaggctggtcttgaacgcctggcctcaagtgatcctcctgccttggcctcccaaagtcgggggattgcaggctagagccactgcacctagcctctctcattctctttgacatcgtcccttccccaagacctaaggccatacctctggcctctctgattccctcctgtgccccaccttctctgggttccattgttggtgccctgcaaccccaaggcttgatggccttcttggttctcttcccctgcaggaagtttgccccaagatgctcagtgtgcggtggggccataatgcctgagccaggtcaggaggagactgtgagaattgttgctctggatcgaagttttcacattggctgttacaagtgcgaggtcaggggcccccagcacgtgcaaggggctggcagtgtctagggtgctgggtagagcatgagggggaacacagaggtctggggttgatggaaacctgttgcttctttcttttttttttttttttgagacggagtcttgctctgttgcccaggctggagtgcagtggcacaatcttggctcactgcaacctccacctcccgggttcaagtgattctcctgcctcagcctcctgagtagctgggattacaggtgctggccaccatgcctggctaatttttgtatttttagtagagacagggtttcaccatattggccaggctggtcttgaactcctgaccttgtgatcctcctgcctcggcttctcaaagtgctgggattacaggcgtgagccatcgcgcccggccaattgttgcttctttttcaacaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaacacttccaagtctgttgtctcatctgattctcccagtagcccattacaggcccagtcattgttac

SEQ ID NO: 8886 - DNA, 7720 bp, Homo sapiens; identical to SEQ ID NO: 8766

SEQ ID NO: 8887 - DNA, 6746 bp, Homo sapiens; identical to SEQ ID NO: 8767

SEQ ID NO: 8888 - DNA, 297 bp, Homo sapiens; identical to SEQ ID NO: 8768

SEQ ID NO: 8889 - DNA, 481 bp, Homo sapiens; identical to SEQ ID NO: 8769

SEQ ID NO: 8890 - DNA, 89 bp, Homo sapiens; identical to SEQ ID NO: 8770

SEQ ID NO: 8891 - DNA, 6333 bp, Homo sapiens
gctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtttgtttcttgtcttttaacatgcctgatatgttctgactgtttttatatgcttaaatatagcagcatgactttggaggcttaggagtgcatgtatttttgaggaaggcctctaaattcatatacttggattgagaaatatgtaaatgacccttctcctcctgtccctcaccccccaccccaatgcacattgttgctgtccaaaacgaacataccagtgtgtagatgttagcaggaaagtgccatttttatttgggttggtagttctggactgtttccttacaagcttcaatttttcacactttttaacggactattaaactttgtgtgtacacgatttaatttttctagagattgaaaaggtcctgttacagccatagagttttaaaatgattttaaatgtatgttgtctgcaaatacttaatattttttttgcatataacaagagtgtcttcattcctgtccattacaacccaaagggatgatgatatcaagtagcaagtcagatttatctggtccaattggccatgaaattaaatagtaatttcactggttttgacattacatggttttaattgaaagtcaaagccagtacaggaaatggtattgccttttcttaggaatgcaatgctagttatcagtggtcagctacaggttaatattaataataaacagtgatggccacttacttggtttatcttgactagttgcttccttttcccaggctagtcttaaaacttcatgcagcattttacgctttaattacattgtcaggttaaccttattttgggagtctttagagttggtttgtttttctttatagttgattcaactaaagttattaattgaactcttctccaaactcaaaggtgtctattattgtagagggaacgtttttttagttttctataccgttacttggagagagaagttagtgggtgagttattattgacctcagattctgcctcactggggcgtttcaaatggacagtaccataatctcttggctccacatggccagcttactactttgaaattattcctgggtagaaaatgtctcaaaatggtgataatcttacgtcttacctttagggcagaataagtcatgttaaagattaaattttagttcacactttgtaaatgccatctctctttgtccttttaaggggcccctgacaaaatgacctatttagaatgaataggtaagaaacaaagtggggcaatggaatgagcacttggcagctggagccctgtgttctctactcctcagtggttaaggcgcagagatttggaaggcagccagacctgggaagttgcttgactctcatggcctcaattcactcttacttgatgggtaaaataataatatctattgtacaagttattgcaagatttaaatgagacaagtaaataaaactcagaatttattgccttgcctttaaatgctagctcttattgagagacctcaggccagtctcatgtcttgttttagcttgctcgttgagtaaaatgaaatgagtggagtagatgatactattgactatgaactagaagcagaatttataaatgattatgtctgaatatgatataattatttgacagcctttgactacctgccattggtatatatggggaatggtgtatggaatatatggagtatataggatgatggacagtgagtctaaaaaacccttctacctctgttttcttatcggtataatggggatgataatagtccatacctcatagggttaatgtgaggattagatgagataaaaatgtaaagctctttaaaaaaagcctggtatatggtaaacactgtacgtttttattatttatcttaatgacacaatgaatgagtagtattcaagactagaatgcaataactagtaaggtgttacatacctgctaattgtcctcaggggcatcccttggcttgatgtaaagggaacgaaagtagtaggccacattggggttagctgatgtaactattaaacatacttgaaagcaagtatttacttttggagtttgatatcttagaaagaaacttcattagaaattaagtagtgattagtaatgagtagggattgtcactcattacatgtcattatgtatattagaatcacaatttcatatatagtgatagcatattgaatacaaaggtttttaaaatcttaactacaaagtttcttagagtaacacagctttaaaaatactaattttgctatactttgtttactaagtaactttttctcttctgtattgttattgccaaagtaatgatacaaaaatagtacaacatgttgatttaaaagttggaaagtgaaaaaaatttttaaaaggaaaaagaatagaagtaagcaaaaatattgttaaagcctttatgcagtgataaaaacagtgacttccagggatatagtggttattttcagaaatattttgcttgtcattttgagggaaaaatatcacagaactgtatttccctaaggattaaaaaatagcaggggttaataacagcatgaaaaattcaattccctatctggattcattttattaacaccaaaagccaagggctggtgggggattggggggggcagacgactgtgtgtgtatattatgcagatatagataaatgaagtatatatagatgaaagatatatatctctatatgaaatatttaggtgacatttgttcactattttatccaaatgccatctaatctgaactttttttttttttgagacagagttttgctcttgttgcacaggctagagtgtagtggcgcgatattggctcactgcaacctccacctcccaggttcaaactgttctcctacctcagcctcctgcgtagctgggattacaggcatgtgccaccacgcctggctaattttttcgtatttttactagagacagggtttcactgtgttggtcaggctggtcttgaactcgtgacctcaggtgatccgcctgcttccgcctcccaaaatgctgggattacaggcgtgacagaactttttttttaacttcaaatatagctgggaccaaatattcctaataataatatgttattcttagttgggaatattctgaaagaattggtagcataaagggttattgacctcaatgctgattgtaagatcctagacagttattaaaattagtctttgtttttgtaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaa

SEQ ID NO: 8892 - DNA, 90 bp, Homo sapiens; identical to SEQ ID NO: 7549

SEQ ID NO: 8893 - DNA, 102 bp, Homo sapiens; identical to SEQ ID NO: 6331

SEQ ID NO: 8894 - DNA, 168 bp, Homo sapiens; identical to SEQ ID NO: 8119

SEQ ID NO: 8895 - DNA, 170 bp, Homo sapiens; identical to SEQ ID NO: 7565

SEQ ID NO: 8896 - DNA, 235 bp, Homo sapiens; identical to SEQ ID NO: 7589
  misc_feature (230)..(230): n equals a,t,g, or c

SEQ ID NO: 8897 - DNA, 135 bp, Homo sapiens; identical to SEQ ID NO: 7602

SEQ ID NO: 8898 - DNA, 196 bp, Homo sapiens; identical to SEQ ID NO: 7606
  misc_feature (106)..(106): n equals a,t,g, or c

SEQ ID NO: 8899 - DNA, 175 bp, Homo sapiens; identical to SEQ ID NO: 7613

SEQ ID NO: 8900 - DNA, 101 bp, Homo sapiens; identical to SEQ ID NO: 6685

SEQ ID NO: 8901 - DNA, 159 bp, Homo sapiens; identical to SEQ ID NO: 7616

SEQ ID NO: 8902 - DNA, 176 bp, Homo sapiens; identical to SEQ ID NO: 7624

SEQ ID NO: 8903 - DNA, 207 bp, Homo sapiens; identical to SEQ ID NO: 7625

SEQ ID NO: 8904 - DNA, 230 bp, Homo sapiens; identical to SEQ ID NO: 7626

SEQ ID NO: 8905 - DNA, 207 bp, Homo sapiens; identical to SEQ ID NO: 7631

SEQ ID NO: 8906 - DNA, 116 bp, Homo sapiens; identical to SEQ ID NO: 7632

SEQ ID NO: 8907 - DNA, 162 bp, Homo sapiens; identical to SEQ ID NO: 6214

SEQ ID NO: 8908 - DNA, 129 bp, Homo sapiens; identical to SEQ ID NO: 7645

SEQ ID NO: 8909 - DNA, 193 bp, Homo sapiens; identical to SEQ ID NO: 7396

SEQ ID NO: 8910 - DNA, 3991 bp, Homo sapiens; identical to SEQ ID NO: 7650

SEQ ID NO: 8911 - DNA, 140 bp, Homo sapiens; identical to SEQ ID NO: 6216

SEQ ID NO: 8912 - DNA, 39 bp, Homo sapiens
gactctgtctcaaacaaaaaaaaaaaaaaaaaaaaggaa

SEQ ID NO: 8913 - DNA, 153 bp, Homo sapiens; identical to SEQ ID NO: 6795

SEQ ID NO: 8914 - DNA, 202 bp, Homo sapiens; identical to SEQ ID NO: 7667

SEQ ID NO: 8915 - DNA, 203 bp, Homo sapiens; identical to SEQ ID NO: 7398

SEQ ID NO: 8916 - DNA, 190 bp, Homo sapiens; identical to SEQ ID NO: 7674

SEQ ID NO: 8917 - DNA, 158 bp, Homo sapiens; identical to SEQ ID NO: 7682

SEQ ID NO: 8918 - DNA, 191 bp, Homo sapiens; identical to SEQ ID NO: 7689

SEQ ID NO: 8919 - DNA, 193 bp, Homo sapiens; identical to SEQ ID NO: 7690

SEQ ID NO: 8920 - DNA, 183 bp, Homo sapiens; identical to SEQ ID NO: 7707

SEQ ID NO: 8921 - DNA, 93 bp, Homo sapiens; identical to SEQ ID NO: 7709

SEQ ID NO: 8922 - DNA, 136 bp, Homo sapiens; identical to SEQ ID NO: 6219

SEQ ID NO: 8923 - DNA, 138 bp, Homo sapiens; identical to SEQ ID NO: 7715

SEQ ID NO: 8924 - DNA, 40 bp, Homo sapiens; identical to SEQ ID NO: 7736

SEQ ID NO: 8925 - DNA, 181 bp, Homo sapiens; identical to SEQ ID NO: 7737

SEQ ID NO: 8926 - DNA, 214 bp, Homo sapiens; identical to SEQ ID NO: 7748

SEQ ID NO: 8927 - DNA, 177 bp, Homo sapiens; identical to SEQ ID NO: 7751

SEQ ID NO: 8928 - DNA, 154 bp, Homo sapiens; identical to SEQ ID NO: 7755

SEQ ID NO: 8929 - DNA, 166 bp, Homo sapiens; identical to SEQ ID NO: 7759

SEQ ID NO: 8930 - DNA, 3098 bp, Homo sapiens; identical to SEQ ID NO: 7763

SEQ ID NO: 8931 - DNA, 2705 bp, Homo sapiens; identical to SEQ ID NO: 7772

SEQ ID NO: 8932 - DNA, 368 bp, Homo sapiens; identical to SEQ ID NO: 6222

SEQ ID NO: 8933 - DNA, 2925 bp, Homo sapiens; identical to SEQ ID NO: 6223

SEQ ID NO: 8934 - DNA, 212 bp, Homo sapiens
tatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaag

SEQ ID NO: 8935 - DNA, 131 bp, Homo sapiens; identical to SEQ ID NO: 7781

SEQ ID NO: 8936 - DNA, 8562 bp, Homo sapiens
tagacatagttttacttcctccttacccgtctgtatgcctttatctcttttccctaatttgctctgctagaacttacagtcatgttgaatagcagtggtaaaagcatgcatcttgtctttaatttttcccacttttaagataaagttttccactgaattttttgaaaggattatacataattaactgattctcttgatcttaattactctttttttcttttgcagcacaaagaatgaaccagcagtggaagagaaaatactgtaagctggctgactgctggtgaagaaaatgctttatttttgtggcaggcatctgtgggatctgtaatagaaatgtaagtgtagcatcatggtttttttcagtgctgcagtaaattaaatggattggtttaacgtgtggtaaattgagtatctgtcatatgtagttttaattatattaaatgagcattttcttttgacttataggtgctttattaacaatttatttacattaagttatcgttaatgtagatttccaagtctcctcaaaaggaaaagtctctataagaaaaactgaagacacaggagtttgctcaaagaatgctgaaatagatctccaggtcctctgggttctaccttctttttacataataattttcttaaataactaagctaggcaagtagtactagcttttgtaaataagacagactactaggttataaaaactctagttactaaaaacttgtttcactaaattaaaggaatttctacataattgatttttttaatgtaataatacatcactgcattttattcatatcacttcactctgatccccagttttactagttgtgctttcatcatttatctttgcatgatatgctttaaagtgttacacactaccttggatttgtccatatttaacttcaccgtattgatgaaacatttttcactatgaatatatttctgttttctaaattcatataagccctatgcaacttgatgtcattcatgaaaaatgtagtgaatattttattgacttttaattacagtgtttttcttattagagcaagagtgaccttggtagatgctatttcacattttcccagtttgacataaaactcttgctttctactcttccagtatgatactggttacatgtaatgatatgtattaacaataattaatttattattaaaagtatgaccatattatttttattcagtattgaaaatttgataattgaaaaatgatactaataagcatttgtctttaaaaatatatattttatttaatcctgtccatttatctatctgtatacattttttaaaatcttaataggtcagatagtctaggtgctggtcatcaaggaacttactgtgatccagtaaatgagacatgtatgtaattaacaaacagtggaatagatgccatattaaggtaacaatcagatgctattgaaactgaacagaggaagagattaatttcatctgaagggttcagaatgaacagaataagtttcaccttgccttcaaagaatgagtagaattttaacagtcaaagaaaattaggaaatatttttcaagccaagggaatgaggagggaaacagctgcctaatcatcaacacattttagaggagtcagggaacagtaatatgtgggaaggcagggtaggagaaagagacttcaaaataagtgcagggagtgaacatttatttagtacttactatattaccagattttacatttatttaacatacaatcaatcttaattgattttgatacttagggacagagtatattgatcagtcttggaggagttaggggacagtacttactagatgttgaggggttagctttgtaaacaagtagcagtaccccatattgagccaggaggaataatgataagacagtaaaggtaaagatagattttcaggatttatttttgacttacctaatttctcagtgatacaggtgttagtatatcgataaactaggagggagaagttttatgatagtctctggggaatagggaaagaaagatgtcttggccgagtaaaagtttactgggattgatggtgtttaggaaatcaaaatagctattaagtgtgtggggttcacaacttttgcaccacacaaaagtgaattgtatggtgaaatttttgtcacttagagtaacttgcttgattattcttttttgcgaatgtctcccttgttggcttttgtggtggtggtctatctttatttcctgttcttctctgaccattccttacaccccttcctggctattttacctcacagatattggagtaattcaagattctgtggttggcccttttgactgctctctctacaggtttaatttgggcatttactcattttcatggctccaaggaccatgtatgtgttggtgagtcaccagacttttttcagctcagatttattcttggagtatcaaactagtaaattcagctgtcatctacctatctccacctggagaccttaataaagtcattatgtctgagacagaactctcctcaaattctgaattttggtgaatgtgtcaccatccatcagtaatcaaatgctttcatttctttttccttagcattcttctattctattgttggaaacttacatcagcaacctccctctaattatcttatacttgcattactacctggatattctagtttccctttcgccatacctcctcctgcattaccaaactttcctccaacctgctgttcaaatggtctggaagctactaaactggctgttatttcctgacgtaaaacctttcagtgaactcctcttgtctcattagtggttcatatgtggaccagcttcatagaaatccttaagccccttgaaattatatgtaggattgttccctttttgtgtgtctgtaattggattctaaattcagactttaaaaatctgatttttaatatttggagtttttattgcaagctaaaaatttcttgaatactacacatactaaagatcttttttgcttataataattttgcctttcatttgactagttgtccaagaagtttcaaggaaatctgagttcttggagatttccactaactctgcccatacccctctatattttgtcttcttgagaagaagacttagtattaatagactcttattagtctggcagaaatatttcacatggtttatctattggaagaaggggatttatacttaaaagttggaatatcacatgaagaattcagtaaaaacgtctttgaaagtaaatgatgtattatacttattaatagaattggactaacgtcactccaaatttctgtgtattaaattcttagtttagtaaactggaaataaattccctttttcaaaattagaattttctgagacatttatgagatagggaatacctcttttgattagcattaatacttgctctacacaaagggaggggaaaagctttcttatttacatattggtatgatcatctgcatacatttagtctcccacctattttaagatcattggaactgcaaaacagagactgtgtagggtagattaaaatggttttttaaaaagccttgaagtatgtcttataggtagactagcagtttggggttactttgtgtctatcttgttacacattttatctctatcttacttattgcatgtgcctcattcagaattaaataagaaatatcactaagtttttctgcccatttgttagttggtgatagactaacagtatacttgatgggctaaacagaatcagaatttataaattgctatggcaaattgatagttaagagtgcttcagatgaaataatgaccatttagctgtctggtgtccattgtttgcagattaactttgtccaacttcacttcattctgatgatggaaccaaaatacctgcacaaacaggattgttttgcctttccaattatgttattataattcatgccttctcctgggatgattgtaattgctttcttagttttgaaattatgtgttttggtttattcataaatgcaagagtaagagtcatgcaaaatattaatcatattaagtagggtggaggataatgtttttaggttggaaacttttttttctgtagataaacgagctgtatgtgatggaaaactgacttcttgggcccattttacttaaagcaaatacaataggtttggaattatgtatttaaaagcatggcattggtccacgtgacatgttgggtgtcttgttttcattttaccagactctgtttttatttatgttttcagtttatgatcctgtcctttgttcataaggtacttagatggtttaagatgtagacttcttatatgaagatgttgctgttgtttttccaaagtaatggtggtcatcagcccatttttctatttagtctcatgaatagaatcatgagtagaatctttcttaaattattacttgtaaatggatcactttcttgttttctttttcttaattggagctttaaataaatatggaacttggaacaaaaagattttcaggaattttatggaaactaacttttttgacctaaatcgaaagggatgaaagtttctgaaaacctaacaaaatgtgtgcacagccaattcttttaggggaggaaataggcagggaatgtgtaattggctattttaaaaacatatgccttcttttgtaacttattgttgtttcaagttacaagatctttgaaggcaagtgtttatctcaaaatatttgaaagcttttatagtgcttaacatactaagacgtcctattagggtttacttagaacaagcttatccaacttgtgggccacatgtggcccaggatggctttgaaagcggcctaacacaaattcataagctttcttaaaacattatgtgatttttttttttagcttatcagctatcattagtgttaatgcattttatgtgtggcccaagacaattctttttcttccagtgtggcccagggaaaccaaaagattagacacccctgacttagaactttccataggttaggagaaagttgtactttcttgatgtctataacctagaatttctggtaaaggaattgattggaaatgttattaaaagttgaaaataatttggaaattaaacattttagtgatcagttcttccattgagactgtgttggttcctttactagatatgtgccatctttttaaaaacttactgtgttgcttcctttactagaaaattgccatctttttgagccttgtctattgaggaaccaagaacacagaaaaggcagtaaaaagaaaaaaaaggattgtttgaagattgaatgtgctgtgatgatagcctaggattattgtttttcaatttttgatgagcgtaagcattcttgttgactatatcttttgtaactactgacccatttagaatggcagaattagctggcagagagattgtcattcattttaagctttcaatctctgacatcttcatctttatttctcagtcttttttacttatcagtggtttactccattattttctccccttttaaaatgtctttttttttttttttttaccatggggaaaaaaattagatgtttccttggcagggcacaataacacaataaggctttcatgacttaacttttgattacctttacaccttcatctcctgctcttccattgcttgtatgactatttgactcagtgtcttgcatgtgcttctgcctggaatctgctccactgcccagcccctctgaatgaacactaaactttctaacctatgtccatcctctcatctctctcttactgttattttagtaagtatgttaacacattttgattacgcaggaatcaggccatattgtaattatctgcatgtatgtttccttatttaacagagtagttgtgtgtcttatttatctttagacccatcagtacttagtattgtatctggaacatggcaggtgtttagtaaatgtttatctgaatcaataaggcagaaattataaattttatgtcagtgtttaagctagatacatccaatttgacaaatcttttttcttcttcctcttcaggggatcttcaatattcatgttattttctcctttggtcttatatgattgttacctttatgaagctttagtgattacaaagcactttttttgtccatttttacctgagctttgtaaactctgatttgcaggtaaggaaatttagactaatggtttaactgagtgcctaagagcacataattaataaaggactctaaaactcagatttttagatttcttgtctagcattcatttcactgtataatagctgccatgattcaaggtatccttttcccctcactggatgcagcttttcattatatagttcttcagtgtgtttctccagggctgatctgttaagtgcactgatggaatttttatacattcccaaggtatgtacaagtagatgcttacaaaaaattttcatcggttggagagtttttcctctactttcatcttcatatccccattgtctagtatgtggcttgcatataatgcacatcataggtggttagtgttttcataattgttaaattaagatattgcaagaattaaaacatgactttaatattatatgtattttttcttaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatggaaataaaactaaa

SEQ ID NO: 8937 - DNA, 42324 bp, Homo sapiens
atgttgtagaccacaaaatccacttttatttggtagtttttacatctatggccaaatagtattgggttgacacagtaatctagagtttacctctgaaaaaaagtaatgtgagtctgtctaaccatattttcctaactcaacagtaggatcatgatggtaaggcaaatgcaagttatttttaccatgattctcaaatgtgaattgaatgttacagtagcaaatacttttgacctcttgtgatgagtcagaactagaacttaattctttgactttcacattttttaaaaagtgtattgctgggatcataaacattttatgttgtgcatttttattacatttacttttgaaagatagttgttagaaggttagttgtttttcaggaaaaaaaagaaatctgatgtaaaaatgcaaatttatgttgcaggatgcttcatgagtcccttcaagtggtttaaaactacatcaacagtagttgtttattactagttggaaattccagggcacacaaatgaatgtccaattgtagaatcagttgactttccatgtcatggctaccactgtttagtaggtaatttacaatagaaaactaattattgaaaagaacaaagttccaaatttgtagtgggtagtgaggtacatctttttttaaatgaagggccatttcccatgaattttactccagctgtttggagcagaagaaaatgattgatcataccctttcttgttttcttgttccctgatacctccccacttttgttctttagcagcaacactcagttattttggtaaattatttccaggtaaaacagaacaaaaattgtatgaaaagtaacgccaggaataggttttgtatagaagctctccttttaaacactgctctttggttataagctaagaattattattggaattgacagcaataatttttaagccaaaagtgtatattttagctaaatgttccagattacgcagtaaatacccaagtgagtaattggcaagaaatgaggtaaatgagttcagatattcaaatgattaaaagtaagtctgcatattaatagtagccttcaaagtaattctgatgttcatatttaatatcatttaacatttatacatattagtcactggagctttacttggagtacatccacacgaaaaaccaattatttattaaattttcctttcttagcaatagcctctaaatttgcaggcccaccccaaactgttcctaaaagatctctttcgttctgtaatgcttcctccaaatatagctctctgcctgaacaaacagattttttcaaagctctaattacttccggtggcccttggatgaattgctttagccattcttgtgcctcttctagagatttagtttcatctgaagactgcaagacctcttcaaccattcctatgtttagagcattttttgaatccagtttaagggccccactcaacactttgagagcttgtctacttccgattatttcaactagccgggtggtgccaccccagcttggtattatgcccatctctttgtggacgaatctgatcttactctctggagtcattaacctgtaaaagaaaaaagaaaagcttaattgtaactctctctgtatgctctaatcataaagtactatccattcatgatctgatgtgaattctccatagatctttataggtaggtatattaaaaacaatgtttgaaaaatatggctgtttcatctagaatttaatttactaatagtatttaaaacttccctttgaaaacagtatcattttttgttgtgcttgtttaccctttgcaaacaagaaccttctaaaagcccaaagttgatctttcttaagtgagtggtgacctaatgagaggatgtggatcaagtgaaagtatgggagtaggaaatgttaggtgcatactaagaaaaacaaaccgaaaagcatagtaagttaaggttctcaaaagtccttagtggggaaaaatgctttttaaatacagcatctattcagcaagtatttacaaagaactaccagtgccaggtggtggtttaggtgctgagactacaggaatgaccaaaacaaaacccttgtgctcaggagctgttttcagtttggagagaaaggcattaaaccatataaagtcagtggcaatgagtgctttatagcaaaaagagaaaaagaaaatgaggcaggagacaaatgaattgaggatatgtgtgctgggggtgtgctattttcgatgaagaaggacactgaatatttgagcagccacctgaggaaatgagcaatgcaaaaatctgggaaaagatgttccaggaagaaggaattgcaagtgcaaaagtcttgaagtagagaactgcttagtatctctggggacgagtacagtgtaactggaacatgggggataaaatgagaagcatacttaacaggccttagtaaggagttcggattttattttttaagtgtaaagttatttagaggaggtcaaccaaagcattaacatctgacattttacaagggctgctctagttgccatgtgcatgaagagcttatttagcatttcaaagctcttatacctttttttttttttttttttaaggaactggcaatacagctattgcagagctaggatttaaacccaggcaggttggcttcagttatcttcatggtacacataatagctagacgaggtggaagcagggataccagtaagaaagttattgatagtggcttggattagactgatagcagtgagtttccctaacgggttcattttccccagtcatgggatttttatgaataggatgattaataagaaagtataacaataaaggggagttaacatttgccagttcaacagactgagtaaagctacacgatttagctttactaaataaacgcccatgcgttttattttgactgcatgcttcaagaagctttcactttcaaattactcattacaaaaaagaagaccttaagttgggttggctttccaacgtgttaaatactcaaatgcaggtgatttggttctattagcactaagaacaaaaaactcagtctttgacccgagagaattctgacaaatgccaacttattaactcactgggaaactttctcttcacagctgtgaatttctacaaaggaaaatatgcctccattatgaacaattgcttctagaggcaaatagctatgaaaaataatagttttcaagaaataattttaaaattgggaggaaaaaagaacaagtcttataaaaatctgaatttatcacaatattgtaagaggagtactgccttgttaaaacaatatcaaaaggaatagaaattacagaaataatgtctaatattcttagaaataggaatattgtcaatattgaacccaatcctataaagctttttacataatacactaaatatgtaactgttctgaattgaatcctagaattggttcagagctgtgcctataatggagtaaaggactatgccaggaatagattcatttagaatcagctgaacataaaaactggttaaagtcctagatgttggaataatgtagatgagcttatgacaacaaaagttattacctatgtaagcacattcatatttggaattatttgcttctaaagaaaaatcatcatctctatggtgatttttttccatttgccttattttataaggtaaagtgtgtcttttggaatcatattttacaactccaacaaatcttgaggttatctttgtaaaaataccttttgtgatcaaaatctaacatccattctttgcaaattgtatacctcgggtgtgcttatgtactgatatacattaaatatatattaaataaatatgaccaaaaaattcattggtgataaaagaacacaagtagtttcctctaataaacagagcattcagatggtaacctttacaggactcttttaacctaaaaatgaaagtttaaatataaaatttaaaatgctgaaaaacctaatttaagaaggacattattatattaacaacaagatatatcccaaaatagtttcctgatagaccctacaggattatacactaattctttctagagtttagatgcagttacctagtaatataattattgcaagggataatctacgtagagtaatggaagacttagctcttataattttgaagactaatgacagactcaatttataaaaccatattaaacttgcttattttgacaagtaaaagaatgataagtgtcttctaactgtttaatagcataatcattggcaatgtttaaaatttcctctgacatcctggggcaaaggagatgagattaatcaaatgtggatatatttcttgttactactgtctggatgaaacaatgttataagaaagactactcataactggggaaagagttacacctttgacaggtgatacaaagtcaagtgttgatgataccaggaaggactgttcagtgagttactacttcttgatgagttaactcttaagtttcaggtcttgaacaaatgtattcaagaacattctaaaaagaaattaccaaattttactaaaataggaagtttttagtggaaaagttgcaaaaaaacagcctttttgtaatgttgattattaaagcaaggtacttctagtaaattctgtgatgaaggatggaaatataaataattgaattggaagagtgtacagctttgatgtgaagtgcatacactcagaagccagactgctgggcttgaaatcctaggatggccactagactggctacatatccacacattgtaaaatacagcaaaggcaaaagaaacatggtacaaagaggagaggaagattcatctctagatcttaggaagttacttaacatctctgtgtctcttgatagatactttgaacatatgtactccacaattcttttatagatagagtgtgtctgtatgttttaaaaaattgtgtgaaattgcctcaaacacatctacaagagaatacagtattacctacttttatttggaaatataaaagttgtatatattttgtagtctgatacataataaactctgtatactagcttttaatactattaagttggtggtattgataggtccgtaaaaataacagtagtgtttctgctagtgaagtagtataaagttgtcccctggactaaaatcccataatctctaaaatattcagagtaaaagagctatactcaacactgtataaccagcaaatactcttcttcttcgatgttggttttataaatggagagcacaagaaatattcaatttttatattgccaaataaagttagaaataatactgtattctaatacagatatggttgaagcagaagattgcaagctgatcttttttaaaaaacaggtaagacagttatccctctaagatttcttagaactgtccaatacaagtaacaagataaatatcttgaaattttaaagaaaaccattgatgttacaaaattaacatgatgttatacatttaaagtttggaatcactgatttaaatataaataagctttagtgtagggccagaaacggctagtccttttacactgattgcataaagggccaaagacaacaaagtaaacttgctcgcatggggaaatatagcatagaaaattatagaattcgcaacagcatctctgaccacaaacaatactttaaaattatgcctcgaacataaacttacttgttcacacgtatattttcctggcactttctcccttttgttttctaccatctataacatcacaaaacaatggaaaagagaaagaacccaaaaattctccctataatctcacctttctgatttccaagtctcagatgattggcttcatgagtttccattcattatatgcaaacagactgcttgagtaagaaggtatatagtcgaatgtgtgaaaacttttatttgttgtgtggttgtgagggggggagcagatataaaaatgttttgtgatactgaagtctgattttaacatttagtaatcctggcatgatcagaggtaaattttcttgatgtcacagctctaaagtaagaacttccaagtaatgtgataactacaaaacaaagcatcatgggcagtgtgactacttcctgaggtggacatctcctattcagagtaaagttacttccaaatcaaaaatgggatttgttatttttgaattggggtgggggcgggattgtgtgtgtgcatgcatttatttgtgtgtgcaagtgtgtgtaatattgtactttatgaagccagtattttttttttttttgagacagagtctcactctgttgcccaggctggagtgtagtggtacaatcttggctcactgcaacctctgcctcctgggttcaagtgattctcctgcctcagcctcccaagtagctgggattacaggtgcccgccaccaagcccagctaatttttgtatttttagtatagacgaggtttcaccatgttggccaggctggtcttgaactccttacatcaggtgatccacccacttcggcctcccaaagtgcaaaaggctaccttgtaagttcccttgggataagaacgtttacagctccctttctttataatatactttgaactaatggctagcagctggaaatgctaataccttggctgagggttatttatattgatgaaaacagcattagaggttgaaaacagataggcaggctctaaattggatagttgagaattttatttcactagggaggaataaaaatgtgcttttcatttggtgtataaacagctcaatatcccaaaggagaaatgggaaaagaaaatgcagagaattcatacacatataaatcaaccaacatatgaaaatttatgcatcaccaaaaatctctaaaaaggcaaatttaatttttgattatcaaaattataaaagatatcttaaaagattatactcattgtaagaaaggatgctctcaaatagacacttattttctgctggtggtaatataaattagtagaatctttcctagaagataacgtggctattaccaaaagccttgaacactgcatatcctttcattaagtatttgtgctacttacatgattttttcaggaaataatctgaaatgtggataaagccttttgcataaggtaattatcacagcattaatcattttagagaaaaattggaaacaacagacctaactgcaagtggaaatctagtacacgatcaggtgttacctcaaatcactggaacacagaaggcagaaggctttctaaaacaaatagtgttgggacaaattgccatttggaaaaaagatgaaataagatccattactcacagcatacatgaaaataagctcaaaatggattagatatataaatgtaaaacacaaaaccattcaagtactagaagaaacacgcatgaacttttctataaccttgatatatggaaaggcttttaaactaccacttgaaatccagatgcaacttttaaaaagattgatagatatgactacttttgtgtgtgtgtgtctgtttttttttagacagggtcttattactccattgcccaggctggagtgcagtggcacgatcttggctcattgcaacctccgcctcccaggttcaagtgactctcctgcctcagcctccagagtagctgcaactacacgtgcgccatcacacccggctaaatttttatacatttttagtagagacagggtttcaccatactggccaggctggtctcaaactcctgatcttgtgatccgcctgcctcggcctcccacagtggaccatgtttttttaaaaaggcttgtgtggcaaaaaagaataaaaacaaaaaacaagcaaagtcaaaaaacaagctgagcaaatatatgcaaaacacttcacagataatgacattatccctaatacttgaagaactttaaaaaattgaaggaaaaaaacaaatatcctgttgagaaataagcaaaatatgaataaataattcaccaaaaaaaattttttaatggtccttaagacatatgaaactataatcaacttcactttaatataaatgggctgtgcgcagtggctcatgcctgcaatcccagcactttgggaggctgtggatcacttgagctcacaagtttgagaccagcctgggcaacatgacaaaaccccgtctctacaaaaaatacacaaattagccaagtgtggtggtgcactcctgtagtcccagttactccggaggctgaggtgggaggatgacttgagtcctagaggcggaagttgcagtgagcagtgatcgtaccactatacaccccagcctgggtgagacagagcaagaccttgcctcaaaaagaaaaaaaaagagaaaaaaaagaaatgcatattaaaactatgctgaaatattgttccttacccatgaaattggcaaattccaaagcttaatagtaggctctgttgacaaggctaagtgaaacagactagagggaatgcaagacttgtctatctcttatggaagaaaattaggcaataattaataaatattcattaactcattaatatttatttaacttttgatttagcaatcctatttctagtgtttatccttaagatatgccattagtattactaaaaagtatagataaagttattcactacaacattctaacatattcaagacataaaataaggctggaaacaagggaaaaaatttaaactgaatgcaaaaactaaatcaaggtattttcaaatgaaatcacattgagggataagaaaaggaaaaatcaggcagacagctaaggctagtccttggagaaatagcctgaaaaatcacagctacaggcacaaacagaacaacctggggaaaaactaaactgcaactacactaataagaaagcaaggcccaacagagaagccttttttcctttgtgtgattagcgggcttccaggaaaaaggttcctccccttttcaggcatatacatggtaggctctgtgggaacctgcaaaggaatgggggtgggcttacctgaaacagacctgcagttaaacaaacaagagaagcttcactttgtgcttacccaagacatacccacagctgcagagataaggagagttacacaaatagctacagagatgaggggagtttcttataaaagcttttggattcaactgtaaaaacagcaacccactcaggccccctctccactacaaagagctttcttctttcacttattaaactttgactccaacctcccccttgcgtccatgctccttagttttcttgattgtgagacaaggagctcggataacacctcagacaacgagaccattcaccccagaccatttcaacatcaaagaaggagaaacaacaaaaacaacagtgaactaatgtaagtaacttttggacacagtacaatactttatttacccttagtctgggtgaaaaaaatatatgatacacaaagataaaacacaatagcaaaatgttaaaaattgttggacctgaatgaatggcacagggaaattatttgtattactgtcacgcctttcctgcaagtttgtaattatttcaaaattaaaaattaaaaaatacaattccagtttctctctcacaccaaattcaatagtaaaatattaaatattagacatataaaaatgtgtacatgcttttttttgccaaaagttgatgctaaaagccaagcagtctgagtttgtcattttctattttctaaggtagttttgagagatttttctctattttcccatgtttttagaataactggaattagaaagtagaatcaaggaatgagtgttttaagtacttcctgaagcacattctggaatcttgatcttgaaaccaagctaaccatccatactacaggtataattatgtttaaaataatgtctatatcagagaatcctttataaataaggtatacagtcatgcactgaataacaacattttagtcagcaatggactgtatgacaatgatcccataagattataatggggctgaaaaatttctatagcctggtgacatcatcgccattgtaatgtcatagaacaatgctttactcacatttttgtggtgatgctgttaaaaacaaacttactgcactgctacctgtacagaagtatagcacatacaattatgtatgttacataatacttgataataataaatgaccatgttaatggttcgggtatttactgtactatattttttttttttttgagaaagggtctcactctgtcccgcaggctggagtgcagtggtgccataatggctcaatgcagccttgacctcctggcctcaagcgatcctcctgcctcatcctccctcaggaatgggactacaggcgtgtgccaccatgcctggctattttttttattttttgtgtctcactatgttgcccaggctggtctccaactcctgagctcaagcaatcctcctgccttggccttccaaaatgctgggattgcaggcataagccaccacagctgacctatactttttatgttattttagagtgttattttacttttatatgtagaaaattaaatgtaaaatagcctcaggcaggtccttcaggaggaattccagaagacagcattattatcataggagatcacagctccatgcatgttactgcccctgaagatgttccagtggggtaagatgtggaggggtaggacaatgatatatgtggaggggtaggacaatgatatggatgatcctgactctatgtaggcctaggctaatgtgtgtgtttgtcttagcttttaataaaaaaaaaaaaaaacttttaaaaaagatgaataaaataaaaatagaaaaagcttatagaataaggatataaaaaaagaaaatactttcgttcagctgtaaaatgtgtttgtgttttacatgaagtgctattacaaaagaataaaaaagttttttaaaattaaaaagcttatatagtacaaaagttacagttaatactgtcttctggaatttcttctgaaggacctgcctgaggctgtttacatttaattttttatgtgtaaaagtaaaaggagtacattctaagtgtacagtaatgtcctaggccttcacattcacttgccactcactcactcacttacccagagagactttcagtcctgcaagctcgattcaccataaataccctatatgagcattcaattttttatcttttatacagtatttttactgtaccttttcatttagatacacaaatacttaccattgtgttacaactgcctatagtattcaatacagtaacaggctttacaggtttgtagcctaggagcaataagctataccatatagccgaggtatgtagtaagctgcaccctagatggtatcattaggtttgtttagctacatactatgatgtctgcacaacaacaaaatcacgtaatgacacatttgtcataatgtgttcctatcattaagcaatacatgactgtatgtgggtactattactgttttctaaaaagcatctaagcaagcatttaaaaaaataaaaatacagtttacaaaattaacttagagtaacaaagttagcacttttcactggcaatcaaacagaaatataaaagttagcaacaaatctgacaattaaattccctatgccaagcccatacgtggtaggtagattggccccgaagagatgacctaatctctggcaactgtgcatgtgttaccatacatggcaaaagagactgcagatgtaactaaagttaaatccttaaaataggaaaattatcctggattaactgagtggacccaatctaatcatgagaacacttaaaagcagagaaatgtttccagctgtagtcagagaaatgcagcataaggataaataagagagattcaaagtatgagaggaacttgactcaccactgctggaggagccacatggaaagcatgagaaagaattcagaaagcatctaggagcaaagactcatcccccatctggcagcaaggaaacagggacttcagtccttcaagtgcatgtaaccaaattctaccagttggaacctgggtgagcctgggaatgaatcctcccctagagtcttcagagcccactgcaactgacacttagattttggtctcatgagacaaggtttagaaaaaccagctgagcccagctagacttcagacctatacatctgtgagataataacgtgttgttttaagccacagaatttgtggtagtttgttatagcagcaatagaaaactacatgtattagcattttcttaatttatatttcattctaaatatctttaatttgtcaaggtggattaaaaaatgagaggctatattaccacatttctagcttttcatttcctcacattaattttgtcactaaaatggaaacataatgcttgactagattctgaccattgaaaaataccaatttttaattcatgttagtcttttacttttaaaaatgttttttaaaagccattttctcttggaatattttacatgaaaagtatgactcaagtgagggtctatctatgcaaagtagaactgagtgtttccgacatacgtatacattacatctattaccagctggtgctcacagggttttgcgggaaggggacagtgttagaatgctacatgagttcatttcttttatatattcatattaagtgtatctccatctgctgaagtacttccattggcatggatgaaaatgtcagttgagtgaattccaggcaattctccaaggtaagaaagttaaacaagcgaaaagggccaacacatataaagaaggaacttatctttttagcaaacgctatgaaagctttcggtgtttttttagaacaagcagacattcttaggaaataattaaaataatctgtcatagaaagtaactgatgaggtactgataaaattaagtggaaaaaatcagctagaggaacttgtactgatttatcacttcctggaaactggggctagtaatgtagttcattcagtatgcaatcctctctattagcctctaacatttaagaactatagttgcttttggtatgcgggttttaaaagggctgagtagcctaggacagtgcttgtcaaatttctctggtcaaggatcaatttcttcttcatttttaaagaaactttctaatcgattgcagaccaataattttgtaaaatataacaaaaacatattactagaaaaatgaaacaaaaaaccaagacacaaggtttgtgaatggctgtgcctagcacatgtgggtgctgaaatatgtttaataaacagacaccactttcagaaaagctggttcaaaaatggataggttttcatcagaagcttctcaacaaaagcacctggtatatccagatactgagagtaggcagtaccctcagacatcttgtaacaaataaaattaaatatttaatgaagctctaggatgcattacattttcttcaattagagaatgacagctaggcaatttagcagtattaaaggattaaataatctctgattatttttcctgctattgtgcttttttgtcctaaaccctaactacacttaaacatagatgagaaatcaatatgaagaatagtacaaaagtctaataaaggtgaacaccggaatctatgttagagggttttcacttgttccaaataacatctaaaaagtcttaattttcatttccttttacacagaggatttttcagtgtaataatgcacacttgcatgtagcttaagattctttttttttttctttttgagacagagtctcgctcttgttgcccaggttggagtgcagtgccgccatctcagctcactgcaacctctgcctcccgggttcaagtgattctcctgcctcagtctcctgagtagctggaattacaggcgcctgccaccatgcccggctaatttttgtatttttagtagagacgggttttcaccaagttggccaggctggtctcgaactcctgacctcaggtgatccacccacctcgatctcccaaagtgctggaattacaggcctgacccactgtgcccagccttaaaattcttttaattatatacttagatgtacgttttatatttatatatgtattgaaattatatatttcataactacctgtattcagtgtaaagtgaggaatgcatttaatactttcacacatacagcatttcctgtttagtctcatatcaagcataaagccaatgactgcttcctcttcgcagaataaaatgtaataatagcagcattctaatgcaatctgcactgatgacagcagagggcactgtcatataaaataacttttttttattgtgcataagaattttgtgcattattgaacactagttttcaagaggctaggatttctgtaaacggtcttatataccaaaaaaactagaaaatctctatttgtgtgagcatgaagtgacatattttaactgatgaattgaaacctgagtcataaattataaaaagaaaaattaatataaaatttactgtttttcataagttagcatactgaaacttttctcattctatttctactactatatgatgccatttatatgaagtcaaaaaaataaaaaatatatttattatagaatatttagcttataaaactataaaggaaagcaagaaagtaattaccataaaattcagggtaaaagccaagttgtgaatacaacaggaaagttcttgaaggaaattcaaagtgctaatccagtgaacacatgaataataaggaagcgaaacagtcttattgccgatgtgaagaaagttttagtggtctggatagaagaccaaaccagccacagcatttccttaagccaaaggctaatccagaacaaggctctaactctcttcaacactacaaaggctgagagtggtaaggaagctgcagaagaaaaatctgacgccagcagaggttggtttatgaggtttaaggaaagaagtcatctccataatataaaggtgcaaactgaagcagtaaggggtaacacagaagctgcagcaagtgatcctgaagatctagctagggttattgatgaaggtggctacactagctaacagatttttactgtaatattaatgatcatttggcagtattccctgtgagccagtggtgacagtggccatggggcgacactcctccacctttggaaaggggagaaaagactggaaaggtctatgtcttgtggtctgagttacagctcagacaagtcagaacaccagctagacttctaaagtttttgactctagtgtcaggctcccagacagcacctctggacttttccagagtctagtggaaatcaccaccctgcagggaagaacacaggcctggatggctttgccacttgctgattgtagagtcctagtccctcaagtgaacataggcagtatccagggggtggttatggaaggccttgggcaagacccagtgctgtgttagcttcagatgtgacccagcacagtcctagtggcggtggccatagggttacttagttcacttcaccctcagctccacggggctcagcagagagagagagagatgtcatttgtttgggagaaagtgagggaagagaacaagagtctctgcctggtaatccagagaattcttccggatcttctccaagaccatcaaggcagtatctccagaagtctgcaagaaccagagcattacggggcttcgggtgccctctaaagcagatacagcttagatcacaacacctacgtccttctgaatatctagaaagcctttccaagaaggaccactacgaacaagctcagactgtgaagattataataaatacctaattcttcaatgcccagataccaaagaacatctacaagtaccaaggccgcctaggaaaacatgtacccaccaaatgaactaaacaaggcaccacagaccaatactggaaaaagagatacgtgacttttcagacagagaattcaaagtagctgttttgacaaaactcaaagaaattcaagataacacagaggaggaattcagaatcctatcagataaatttaagaacaagattgaaataaaaagaaccaagcagaaattctagagctgaaaaatgcaactggcatactattgaagaatgcatcagaactttttatggcataactttttatggcagaaatgatctagcagaagaaagaattagtgagcttgaagacaggctatttgaaaatatagtcagagaagacaaaagaaaaaagataaaaaagcatccctacaggatatagaaaatagtctcaaaagggcaaatctaagagttattggccttaaagaagaggtagagcaagagacagggttagaaagtttattcaaaggaataataacaaagagcttccaacacctagagatagatatcaatatccaagtacaagaaggttatagagcagcaaagcagattgaacccaaacaaaagtacctcaaagcatttaataaacttccaaaggtcaaggataaaaacatggtctgtaataaagaaaggatcctaaaagcagcaagagaaaagaaacaacacacaattaagctccaatatgtctgggagaagacttttcagtgaaaaccttacaggccaggagagaatggtacgacatactgcaagtgctgagggaaaaatcctttcatgctagaatagtatattctgcaaaaataccttcaaacatgaaagagaaataaagacttccagacaaacaaaagctgagggatttcatcaacaccagacctgtcctacaagaaatattaaagggagcactctaatcagaaagaaaacgatgtcaatgagccataagaaatcatctgaaggtaaaaaactcactgataatagtaagcatacagaaaaacacagaatattaaaacactgtaactgtgtcttatcttaagtagaaagaccaaatgatgaaccaatcaaaaataataactacaacttttcatgacatagacagtatacaacaaaaaattaaaaagccagaggataaagttaaggcataaagtttttattattttctttttgcatgtttgcttgtttatccaaacaatgttcagttgttatcagcttaaaataatgggtgataagatagtatttgcaagcctaataagatgcagtatttgcaagccaaaaaacataaaagatacacaaaacaattaaaagcaagaagctaaatcaaatcactgagaacatcatcatcacaaaaaggaagaagaaaagaaagagaagaccacaaaacaacccaaaaaacaaataaaatggcaggagtaagtccttacctaccaataataatattgaatgtacatggactaaactctccaatcaaaagacacagactggttgatagattaaaaaaaaaaaaaaaagaccaaatgatctgttgtgtaccagaaacacatttcacctataaagacacacgaagactgaaaataaagaaatggaaaaagatattccatgacaatgaaaacaaaaagaaaacatgagtatctatatttatttcagacaaaatagatttcaagacaaaaattgttaagaagagatgaagaaagtcactatataatgataaatgggtcaattaagcaagaggatatgacaatttttatgccacccatcactggagcacccagatatatacaggaaacattattagagctaaagtgagagataggccccaatacaataatagctagagacttcaacaccccacgttcagcatttgatacggtttggatttgggtcctcacccaaatctcatgtagaattgtaatccctaatgttgtaggaggaggtgattggatcatgggggcagccttcccccttggtgttcttgtgatagtgaatgagttctcatgagattttgtttaaaagtgtgtagtacccttccccttttctctctttctcctgctccagccatgtaggacgtgcctgcttccccttcatcttctgccatgagtgtacatttcctgaggattccccagccatgcttcctgtacagcctgtgggactatgagccaattaaacctctcttctttataaattacccagtctcaggtagttctttatagcaatgcaagaatggactaatacagcactggacagatcttagagacaaaaaatcaacaaagaaacatcagacttaatctgcactatagaaacaaatgtacctaatagatattcatgcaatatttcctccaagagctggagaatacacattcttttcctcagcacatggatcattcttaaaagtagaccatatgtttggtcaaaagacaaatcttaaaatattcaaaaaattaaaataataaacatcttctgtgatcacaatggaaactacaaatcaataacaagaggaattttggaaactacacaaatacatggaaattagacaatatgctcctgaatggccaatgggtcaattaaaaaattaagaaggaaactgaaaattctcttagaacaaatgataatgaagtacaacataccaaaacctatgggatacagcaaaagcagtactaacagggagtttatagctataagtgcctacatcaaaaaacaagaaaaatttcaaataacctaataatgcatcttaaagaactagaaaagcaagagcaagccaaactcaaaattagtagaagaaatactaaagatcagagcagaaataaatgaaatctaaattaaaaaaatattgactgggcatggtggctcacgcctgtaatcccaacactttgggagaccaaggcgggcagatcacgaggtcaggagtttgagaccagcctgaccaacatggtgaaagcccatctctactaaaaatacaaaaattagctgggcatggtggcatgcacctgtaatcccagctactcaggaggctgaggcaggagaatcacttgaacctaggaggtggaggaggttgcagtgagctgagattacaccactgcactccagcctactgcactccagcctgggtgacagagtgatactctgtctcagaaaaaaaaaaaaaagacagaaagaaaataatacaaaagagcaatgaaacaaaaagttgttttttttgaaaagttaaacaaaattgaaaaatctctagccagactaacaaagaaaaaaaaaaagagaaattccaaataaataaaaccagacatgaaaaaggagacattataactgatactgcagaaattcaaggattattagtggctacaatgagcaactacatgtcaataaattgggaaatctagaagaaatggacaaattcctagacacataaaacctaccaagattgagtaggaagaaattcaaaacctgaacagaccaataactagtaaggagattgaagatgtaataaaaagtctcccagtaaagaaaagcccaggatgcaatggcttcattgctaaattctgccaaacatttaaagaagaactaatggcaatcctactcaaactattccgatattctgaaaaatagaggaggggatacttccgaactcattctgtgaggcaagtattaccctgataccaaaccagataaagacacatcaaaaaaagaaaactataggccaatatctccaatgaatattggtgcaaaaatcatcaacaaaatactagcaaactgaattcaacaatatattaaaaagatcattcaacatgaccaagtgaaatttatctctgggatgcaaggatggttcaacatacacaaatcagtcaatgtgaaacatcataccaacagaatgaaggacaaaagctatataataatttggactcatgctgaaaaagcatttgataaaattcaatatcccttcatgataaaaaactaccaagaaactaggtatagaaggaacatacatcaacataataaaggccatatacatatatgacagaccttcagttagtatcatactgaatggggaaaaggtaaaagccttctctctaagatctacaacacaacaaggatgcctacgttcacaactgttattcaacatagtactggaagtcctagctagagtaatcagacaagaaaaagatataaaggacatccaaattggaaaggaagaaatcaaattatccttgtttgtagattatacaatctatgtctggaaaaagcctaaagttgcaaaataaaaaatcaacatacaaaaatcagtagcttttctatatgtaaacagtgaacaatttgaaaaagaaatcaaaacagtaatcccatttacaatagccacacataaaattaaatacctaggaattaaccaaggaagtgaaacatgtctataatgaaaactataaaacaccaatgaaagaaattgaagtggacattaaaaatgaaaagatatcccatgttcgtggattggaagaatcaacattgttaaaatgtccattctacccaaagcaatctagatattcagtgtaattcccatcaaaataccaatgacattcttcacataaatcgaaaaaaagatcctaaaatttatatggaaccacaaaaaacacagaatagccaaaactatgctcagcacaaagaacagccctggaggaatcacattacctgacttcaaattataccacagagctacaaaaaccaaaatagcataaaaacagacaaccagtgaaacagaatagagaacccagaaacaaatctacacatatacaggcaactcattttcaacaaaggtaccaagaacatacactggagaaaacacagtctcttcaataaatgatgctgggaaaactggatatttatatgcagaagaatgaaattagacccctatctatcaccacagacaaaaatcaaatcaaaataaagaaaaagaaaaaacccagaaaacaaacaacaaaacacacacacacacacacacacacacacacacacacacacacacacacacacacacaggaaaaaatagattaaagacaaatttaagacctcaaactctggaaccactaccagaaaacactggcgaaaatcttagggtcactgtacttggcaaaaatttcttgagcaatattccacaagccctttctcacactgctattaagaactacttgatactgggtaatttatgaagaaaagaggtttaattgactcatagttccacagattgtatgggaagcatggctggggaggcctccagaaatttacaatcatggcagaaggcgaagcggaagcaggcatatcttcacatgacagagcaggagagaaagagcgaaaggagaagtgctacacacttttaaaccaccagttcttgtgagaacttacgcacttatcatgagaagagcaagggggaagtctgcccccatgattcaatcacctcccaccagacccttcctccaaaattgaggattacaattcaacatgagatttgggtggtgacacagagccaaaccatatcaacaactgaattcatggagatagagagtaaaaagataattaccagagtctgggaaaggtagtgtggagttggcagggggatggggatagttaatgggtacaaaaaaatagaaagaatgaataaggtctattgtacagaacagggtgactatagttaataatataataataacctaattatacatttaaaaacaactaaaagagtataattggattttttgtaacacaaagggtaaatgcttgaggggatggaaaccccattttccataatgtgattattacatattgcatgcctgtagcaaaacatctcatgtaccccataaatatatacatctactatgtactcatgaaagttaaaaattaaaaaaaaaaagttgttttcaatcctcatggttggctttcaaccctcaggaagatttaaggagttcaagacttcaatggaggaagtaactgcagatgtgatggaagtagcaagacaattggaattagaagtagaacctgaagatgtaaccaaattgctacaatctcatgataaaacctgactagatgaggaatggcttcttatggatgaacaaaatatgtggtttcttaagatggaatttaattttggtgaagatgctgtgaacactgttgaaatgacaacaaaggatttagaatattacataaatttatatttgataaatcaacggcagaaagaagttctactatgggtaaaatgctatcaaacagcactgcatgctacacagaaatcttttgtgaaacagtcaatcggttaacaaacttttgttgtcttagtttaagaagttgtcacatccacctcaatcatcaggaagcaccactctgatcagttagctgccatcaaaattgaggcaagattccccaccagattacatctcggtgaaggctcagatgattggtagcatttctcagcaataaattaccttttaattaagatagatgcattgttttttcaaacataatgctattacatacttaacagactatagtacagtgtacacataacttatatacgcactgggaaaccaaacagttcgtgtgactcactttattgtgatattaactttagaggggtggtctggaggaaaccaaacctgtgatatctatgaattatgcctgtaccaagatggcagatttaaacccaattatatccatgcaacactgactatgtatatggaacaaacactccaattaaaaggcagaaattgtcattctgaataaaaaagcaaaaccgtagtatatgttgtctactagaatctactttgaacaaggcagccaagttaaaaatgaaaggacagaaaaagatacaccacagaaatgttaaccataagaaaactgggggccaggcgtggtggctcacgcctgtaatcccagcactttgggaggcagaggcaggccctggatcacgaggtcaggagttcgagaccaacctggccaacatggtgaaaccccatctctactaaaagtacaaaaattaaccaggcgtggtggcaggcgcctgtaatcgcagctactaggaggctgaggcaggagaattgcttgaacctgggaggtggaggttgcagtgagctgagatcgtgccattgcactccagcctgggtgacagaggctctgtctcaaaaaaaaaaaaaaaaaaaaaaaaaaaaagaaaagaaaaaagaaagaaagaaagaaagaaaactgggatggctatatttatatcagaaaaaaaacagatcttgactgaatcctggaccagaaaaaaaaaaaaacattagtatgataaatgaaaaaaactgaatgaggtctgtagattaattacaagtattgtatcaatgttaatttcccagttgtataattgcactgtggctctataggatactaacatttggggaaactgattgaaaggtatatgggagttatatgtatgatttcgtcaagtttttcataagtgtatagttagtgcaaatgagaagttgaaaacattttaaaaattcaaatttctgctcttccaaagatactactgataaaaaaaaaactcacaggctgggagaaagtattctttctcctaaggctgtgaataatagtatttagtattaaagtagagatagacatagacacacgagcatacttcacctctgctactataattattgctatcccaaggaattttatacagaatatataaaaaactcctacagtttaataataataagacaaatcaatttctttaaagagtcaaaggatttgaaacaacaaagaaaaagaagatatggccaataaacacaaggtcctcaacaccagtcactgtggaaattcaaatctgaaatcacaatgagctctcacaatggttcccacccgtcaaatggctaaatctaaacagcttgacagtaccacatgttggtattcatgtggtgcagctggaactttcttccattgctcatgagaataaaaattatacaacccacctagaaaatttaagaaaccaatatatttgctgcttaagttaaacatacacttaccatatcaccccagcaattccactcttagattttcacccaaaagatatgacaacatatgcccacacaaatacttatacatgaatgttcacaacagctttatttataataggccaaaacaagaaatagctcatgtgcccattaatgtataacacttactgtgctatataggcatagaaagcaatactactaagcaataagatgaacaaaccactggaaaatgcaaaaacacagataaatctcagaaacaaacttgaatatccatgcaataaaatacttttcaacattaaaaaggaacaaagtattgacacatggtacaacatggatgactctcaaaataattacactgaattaaagaaggcagacattaaaaagtacatactctatatatttatgtaaaaatgtatttatgtaaaattcttttttaaaaatctactttaaagtgagaaagtgatcagtgtttaccttgaaatagagatatgaactgactgggaagaggcatatgaaaacatatagataggggtgataaaaatgttctcaatcttgattgtggaggtggttacatgggtgtatatattcatcaaaatccatttacagcatacaattaaaatggattcattttattgtatataatttgtagctcaacaaatttatttatttatttatttatttgagacagagtctcactctgttgcccaggctggagtgcaatggtgtgatcttggctcactgtaacctccacctcccaggttcaagcaatccttccacctcagactcccaagttgtaggactacaggcatgtgccaccacacctggctaatttttgtattttgagtagagatagggtttcaccatgttggccaggctggtctcaaactcctgacctcaggtgatctgcctatttcagccccccaaaatgctgggataacaggcatgagccaccacgccaggcttaaaagtttttaaatgtacaacatgatgttttgaaatatgtagagcactacatgccagcgcagaatcactttctcttcagtgtctgaaactgagacaaaaagtttactagaagtcttctcttaatgtatatccagtatttttcttagctagggtcaagtgtataatgaatttttaaaaaaatggcaaggccagggttagcccagagactgaaaaacatcccaaatgaaaagacaatgagtttcaaagtatgccacaatgttatcatattggcactggtaagagacagttgtataagataatcttaaaactctaagccacaatattatgtgaatattgatgtaaactttaggttaaacattatgctaaaacctatattttcactatcttatttaaatctatttataaatatttaagggagatacttccattttatagataaagaaactgagatgaagagaggtaaaatacttgctcaaagtcaagtagataaaagtgtcaaactgggattcagcctaggtctactagacgtcagtgctcaggctctttactgttttgccattttacctctgattgtgctatatttactaccttttgcattataaagaggctccagtatgtgaacctgtacagataactcacagagcattgtattggtctccttatagctagctgtgttagtaggccttgggaatggtactgagaaagcagtttaaaccatgtctaaagcattagattttataaaatgtcatttctatataatatagctatcaaatactgagaataattattgggagtgaagagctattggtcccaaagaactttctctatttttagtccctaatcttcctgaaagtcccacaaagttgctataaatcacagcaaaaagaagacaaagggatctcagaaaatctctttttattggtgagaagacagctacagcagtctctctttctgcattctatttttcttttttaatgttgcttacctttgtttgtataattcttttggatttttaagtttcatatatttccttagctttccttccaggagttttgctaatatggatttgctctattcaaaatctcaaaaccatgtgttttgttaattttttgaaaatgcatagtaatgaagtgatcatgaaattttattagattaaaattatctactttaatgactgacaaaaagaaaacattcagaaaagaaaataggtttatcctatttaagaatatataaaatattgatattaaggcaaaaatgaatttgagcaagttaattatatttgtgcaagaaattaatgaaattttcatcctacctgaaatcacatgctgtagtaaattctgctcctccacccaatgcccaaccttgaaccagcgcaacacttattaaaggaagtctgtatattgaagaaaaaactgatgttactatttttaatttcaatattcatttacaaatgttattttttaaaaaatcttaaaatgcagtggaaacaaaattattgcactgtcttcataaaaacaaacacacatcaaaggatagcagaagcttgaacctttacatcatgagaagaaaaacagtgtaatactaaacatacaatagttcacaataaatgccacataagttcattaaaatacctccctgaatcattatatatttttaagctatagccatattgtaacttactcccaaataaatggatgcttttgtctaatttacagctcctggaacttctcagcagctggctcttcagaataattccatgtgatattatctttgtccatttttgttggtatcaggttaaaagttggaaaatcaaggctatttccaaaggttggaaatgtgttacagaagatagggctccaaaactgtgttatgaagtttccttcaaaaatctactcattgttgcctgaaataatccacagactaatcctatataaaggcatgattttgcagtaaaaataaatcttttacctttcctgtttgcaaagacccactttgcaggggtgtgtgaatacaaggtaaatctaaaatgttttccaagatggaatttttgtaggttctgacctacaatgcaaaggtgcaggtctaaagtaattgaaaatttcctaatatacactgctcccatgtagaaaggattatttaaaaaaataataacttcagatttatctatgaaaaagtcaaatgcaataggaaaaggaggtgaatagggtttaaacaatgaagatactattttagaatagtaatgttatgattctattactctctctagactctcagatacaataggtaccaaaaatacagtaatgtccaattaataaccttgcttaaataagaatttccttacttttcataattttaaatttgtctacattcggaatgtgaaagtagaaagctaatcaaccaaaacatgtcagtttgtaacctcaaacataccttgataggccaagaagaatttttcctctttgcttctttacctaggtgcaaagtcaattcatattcctcagaaagctgtaaaaactttccaatccatagttctttttctcatctcctctggatacagaccacttcaccacacattctactaatttggaatattaggtaaactttatgtgtcatgtcttgatcagtgtctttattattctgctctaataccagtatttaactttcccagtatctattcctaaatacagctagttatataagctctttaggggatatgtcttaaatttttcttatctttcatttctcttatttttaaaatacatatgtatatacttcattaacatgtaattaaatgattatcctctacggcacaaaaaaatagtacatcattagaatagatgtaatttgaaaattagctattatttcttaactagtacaaataatggaatagcaaaaagctatttttggtcttttagaaatcatattttaaaaagaaggctgcattacctcataaatcttgttaaggtgttttgcatgaacatgcatacggccattccatcctttaaataaaaataagcagaaacacaaaggtataatgcaaatatattacattaaattttttaaattaaggttttagaaagtaatgaagccaaaaatatgtcttttttaaacaatgacatttccatttaaaactctttgatgttgtctgaaatgcaaataatgctgtatttgactgttgatatcctagggctccttgagctcagctttgcatgaggtattagcaaagatgtagggataagagacagatcacataccctagatcactatggagttctactcagggtaatgacaggggaaaggcataagatatacccatctgttatccttaagatgataaacatataagagaagaagggaaagaagggaaaagttatgttaagctttgatttttaaaaaaatatttctaaggctttatcttggtattgccacaacttataattttcacaaacaaatttcctaagagtagtccaaactcattgccttgtcttttttttagctcacatactttcttcaatccagtgtaatctggccctctgccttatcccaaaatctctcctcaaaagcttttaataatctcctacttgtcaaattaaatgacttttccttattcaccttttctctctccataacacgtagtatctttctttaatcagtttcttcattctcatatttgctctcactttctagcaacatttacacacctggttctcttatttctttgtttgttcttttccagtcttcttccttggctcttcttatccagctaatcccctaaatccatgcagtttcaaaattctaatccatgattttctctgttctttatttataatttcttttttttggaagtctcatctacttccatataaagtgctaaaatctactagacattttcacattctgatagcacctcaaactcagcacggcaaaaccaactgaaagtaaaagaactgactttgaatcctagtgctgccacttaataacaacatgaaattgagcaagtcatgactacgtaattcagtttcctcattcataagaaatgagaaattaaaaaaaattgcactatttgacttaaaggatgtttagaaagatgaaaatatacctagaaactctataaaagattgcataagtgttctgtgttagtggaaaaagttagtgtaagagttctgagctagcggtcaataaggctcagatttttggtactatgtttgactttcccgtttcacaattctcccacactcagttagttaccaagtacttcccctcggatctaccttagaaatatttcaaatatcaatcccttcttttatatttttgctgctgctgcattagttcatacctgtgttactcaagccttgattagtacagtaagatggctttgctttctcccacccaaggactaatcagacccaacactgattaacttctgagatcggcaagattgggtgcattcagggtggtatggctggagacaacagctttgcttcctaactgatttctgtatttaatttctttttcctcttaaatataatcttccatcctgctacctgataaaccttcctgtaggatgatgatgtcttatagaataaaacctaaatttcttggcaaggccacttgatcccaaactatcttatcaactttattgattaccatacccctcctccaagcatcctaatttcaccacacaaactatttgccatccctctaacaccttacacttattgtggctcctgtgtctttgcttttatcattcctactagttgtaataggctgtccttctctctacctatttcaaggaatgcccagatcatataatatttttccatcaagattttctaaatctcacaataacaattttctcttttgtgtttcaacagtatttttatttttatgccttaattatagtacttataaattgtgttgtatgaatatgtgtttagatgcattatcagacacatcatctctacaagatggggactagagaacctaagaagttctcaataattttgccagagatacagaaatacaactatcaaagtacaggtattatacaaagtgcttgaacaaactcagaagagtgtcaaagaagaaattattcatttcaattgggatgggggtagttagacaggctttagagaggagaagggaaggtggcatttgctaggtctagacagtaagtcccttgatggtgacagtatgccttccccctcctcagacgctagtaaaatgttttgcacatagtgtttgttgaacttaaaaaaattagatgaattttagatggagaactatgttgatttataaaacaaatgcagtcaagaaaaagtaaaagccaatgtggaaggaatttcctaatccaaagctgttatcaggaagatcagtgtatctcacgaagtgatgagaaaattaacacaggcacgaggagctaaaaagctttcaaagtaaactggtttattctctgctaaaaacctttccaataaaatctgttctattacctatatcaagtaattttaatatgcatatttgctcttgctacatttagattacataaaattccaatgaagtatctagaattggtagaaataaaggtgaagcaaattattagcctgtgtactattataattttcattcaaaagacaaaaggcacgctaaaaatgtctattagaagcagtatgaagtaaacggttaggagcacagtttctaaagccaatctgcctacatttgaatctgggctctagcactttctaattagtttgactttgcccaagctgcttaacctctctgtcctacagtctcttatctgcaaattgtgctaacagtagtatatattttattaagggagctagtaatgattaagttatggcacaaaataaggttagaacagtgtctgacatacagtaagagaataaaagttatctatcattattattaatattactaacaatactggcaatagataatgagtatgttttggttttaagtgtatcataaaacagaagtttaagcagtaatggccaacatgccctagagatgagaaagatttcattaaatttgtcctccaaagttattaagcccacaatggttaaatgctctgtcctctcactgggttgaagaaagcaaataagccagtaagagatatctgtgatagagtaagctgtgggtgaggaaccagtaaaaagctagacctgctctaatgtataaaagctggaagctgagaagtactaaaacaaggttttcaaagttgctgcagacagtgatattttcatgctatctggatgatacctgagatccaaccctactcctctagctccttctcataaaacaaggataagaagaacaatgctcaaccaaaatgccaaaaggaatgattaacatcatatgtactctaagccatgtttagagtggaaaaatgcccagcctgtagaagtatcttatttagaaacaaaaataagccctttcttaagtgcttgttgtatggatttattaatttcctcaaaatacatggaagagcttagagaaaattaaaatagttttttttttgctagagtattgctctgtctcccaggctgaagtgcagtggcgtgatcttggctcactgcaacctccacctcctgggttcaagtgattctcctgcctcagccttctgagtagctgggattactggcacctgccaccatggccaagtaatttttgtatttttagtagaaacgggtttcaccatgttggccaggttggtctcgaactcctgacctcaggtgatctgcccacctcggcctcccaaagtgctgggattacaggtgtgagctaccgtgcttggccgcttgtctgtaaattaatcagggtatggtacaatagtagtagcaaacacaaggaagtcagacaagaactttgaggtcaccatagaaacataagcaacagagatcgaaggaacaatagattgggagaaaagtaacaaggaaagttaagggacaaaggaggatatagtcttcaaggtagattaagaacagaaaggtttctaaatgccagacttttccttgaggcattatactgatccattgaagactaagcaggtttttatttctccatattctgaagcttataactgcactttgattacttattccctctgaaaagaaacttcttatagcctacaggacatctgtggcatcaaatccaagtcttaatatttaaatatatttttttctattttattcctttgtctttccaatacataacttttcagcagggttaatgtttgtgttatcctagtggatctcctggcctctaccatctgaaccaagaattaactgcctaatagggacagttggagctcttttcctgcacaataaccaaagcataccaagacgcgatcaacttcttatgggatcagttacacttaaaagaaaaaaaaagtggaataatagataagaaatataataaaatattgatagggttgatgctcttatgggtacatgagggtttcactgtattagtctctgcttttacctgtattttgtagtttacattaataaaaagctttttaaaactgaaaaaatacagtagtaaaaacatcaaaataattatatttttatgataaaaaagccacttaatcacttccaagcattttatcactattagaagggaatataatctaattgctaaaattgtcatatatttcagttatctcatcatcctcagaaagcaaattcagcaagtaagtagatgctagtgatgcatctgtaacaacaaagagtaagtatttggataaagaagagcctcactaacagacaaactgtttataacttaaagccatgataagtttcagaatgtttcagccatgaggggtagatgcatttatatgttgcagctgtaactcatatataatacatgtataagcctcaaaagtcctgaggccattttaagtttcagctttacacagatttatagttccttctcaagtatataggaatatagtttataggaaacatggaaatatcgggaactttacataaactatttctagttcttgttaattttaaaatcataatgtgataaacacattccatactttatatgtattgttacaattcttaaaattatccatattcaaagtgcttacttttatgctatatatttcttatactatgacttcagagatttcattaaaggataataaagaattcatctaccctataaaatgctttttcaaatagctggacgtcgggccaggtgcagtggctcacgcctgtaatcctagcactttgggaggctgaggcaggtagatcacctgaggtcaggagttcgagaccagcctggccaaaacagtgaaaccccatctctactaaaaatacaaaaactagccaggtgtggtggcgggtgtctgtaatcccagctacttgggaggctgaggcaggaaaattgcttgaacccaggaggtggaggtcacagtgagccaagatcacaccactgtactccagcctgggcaacagaaccagactccatctcaaaataaacaaacaaaaaagtagctaggcctggtggttcatgcctgtaatcctggcactttgggaagccgaggagggcagatcatttgaggtcaggagtttgagaccagcctgaccaacatggtgaaaccctgtctctactaaaaatacaaaaattagctgggcatggtggcccacgcctgtaatcccagctacttaggaggctgaagcaggagaatcacttgaacccaggaggcggaggttgcagtgagtcgagatcgctgccactgcactccagcctgggtgacagagcaagactctgtctcaataaaataaaacgagatcaatgttttaaataaaataagattctgagttctaggcatactcattgtaaagcagattcaccattccacatttccttgataagactgacagatgtatacagcaacaagtgacgaacacttgcagtaatactactcctcagctgttaaccaagatttacttcaggcactgaaaagagcagattacttggagaatgtaggtactagaaagaatgaactttactaagtgattccttatttgaagctggaataaaaactctctccatgttttcctgcatgacttatgccagaccaatgatgtatatatactatatatatatgtgtgtatatatatatatacaatgatgtatatataaaacaataagcatgtttccacttccatctctaaatatatagaaaaagaatcgtggtcacatgatctaaagagacagaaacaaccttctaactaaaagaaaattagaaagtaaaataaccactcactttttagagatgttttcctaaccagcttatatcaaacccacaacagtctattatatcattctgtctttaacagtgtctttcatgaactaaggtgaacagtgatacaaccatttgagagatgaaaaatacatatatataggttgagctatgaaaatatgaaatctaaacgctccaaaatctaaaactttttgagtgctgacatgatactgtaagtggaaaattccacacctgatctcatgtacacaaactttgttttgcgtacaaaattaatgaaaatactgtataaaattacctccaggctgtgtgtttaaggtgtatatgaaatataagtgaattttttgtttagagttgggttccattcccaggatatctcattatatatatatatgtaaatattccaaaatctgaaaaaatgtaaaatctgaaatacttctagttccaagcattttggataagggatactcaacccgtataatcaaatgacttgcaggtgacatagctaattattagatcttggagggaaaaatccgtcttttcaaatttccagcttagtgctataaccgttcagatacatcacaaatttaagtctagtggggtgctacaaattatgcatcatctcattaatgataatgtttactaatctcaagatctttgaaataaaaataatagctacctttttcagatacggtgctagtaggcactttatatatattatcttgaatcctcacaatagctcagcgaaatatccactatactcctcatttatagactaggaaaataagatttagaaagattaagtgacttgcccaatcacttagccagaaagtattgaaaccagctttcaaatccaagtttatcaaagccagtgttctgattaaccaaaagattcttcctcacatgtgcaaataataatcatatactacatacagtggcatgagacttatggaatatcatgaaaactttacttttttccctttctaatttcatttccttcctttcttttcttttctttgtttttcctagaagatgtggtagagggggaaggagcactgaattcatgaaaacaagttccttggaggattgataaaggaagatgatagtatttctactctgtcagggtaattcaaaagcatatttttaaatttgttactacttcttgaactttactatgtgccagaactaggtgatttatatacatagctcatgtaaaacttatcatgagatgctaaagagcttccacttaaaggaattcaaattcttgctgatttttaatgatgaccacttttgttcattgctaatcttcctgtccttcattttcttcagcccttcccactactgcaccctaatctttaaaaagcaaaacaaataaacaataacaaaagtactgacttcatatgactgctaaaggaaaagtgatgatattgaatttgatctatcatcttaatattactaatttatattacctatttaaaatgttacagtagctccctctagtttacaaagcactttagaatacattagctaactcaatcctcaaaaacgcctgtgagatagattttatatatcccatggagctgaggctaagaggaaattgagcaactttctcatttagttgagtggcaggcctatgtctaaacccaagacttctcactctgcattaagagcttttctttatcctattttagtcacaggtaggctcgactaacccaggaatgtgctatatcaatgtacttgaaaaacagaaacacctaacacctagatcttagtttctatcaccatcctctaccattttccataaccaggactccttgaagaaatcaccgattatataattggagcagggaaaatacaagattaacttggagtatctaataatactagaaagtaagggagtactcaaaaaacaaaaggataggggagtgacaaaagaagacaggactttgggtctttggtctttgggcttccaatggccaaagctggaacaatttgagcaacaaaatgaataatgcatataaaataaatatccatgagtgcatattgatataaataactgaataaataagtatgtgagtaaatggggaagaagacccaaatcccccttacataagaataatggacttatatgtcccccttccaggagatggaatttattttcccttcccccttgagtgtagactaaacttagtaacttgcttccaaggagtggagtacggaaagtaaatttaaaatagagtaaccaggcaaacactatcttcgccaggtgaccaaggttaacatcattagtgataagtcaccttgacagcatattcccttgatgtgatgtgatgaaaatagaagcttacctctggtctttctctcagaatcccataaccccagcctaatatgagaaaaacaccagacaaattccatttgaaggatattctacagaatatctaaccagcactcttcaaaactgccaaggtcatgaaaaacaaggtaagtctgagaaactatcataggtaagaggaatctgaaacaatgacagctaaaggtactgtggtgtcccggatttgatcttgaagcagaaaagggataccagtagaaaaagtactgaaatatgaatgaagtgtggagtttcttttttctttttaacactttgttgaattatgactaacaggtaaaaagctgtacatattcaatgtatacaacttgatgagtttgtagataagtatacacccattaaaccatcaccactctcaaggccctgacatatacactacctcccaaagtttcctcccaccccttttattattattattattaactttgtgtgtatgtgtaacaagaacactcaagaccaatccctgcccatccccaccaccaagcccctgataatcaccattccagtcctggcttctctgagtttcactatttttttgagacagggtctcactctgtcacccaggctggagtgcagtgacaccaacatggctcaatgaagccttaagctcctggactcaagcaaccttcccgcctcagcctcccaagtagctgggactacaggcatgtgccagcacacccggctaatttttttaattttttggtagagacaaggactggctatgttgtccaggctagtgttgaactcctggcctcaagcaatcctcccatctcagcctaccaaagcactcatattataggtgtgagccaccatgctaaaataggtttcactattttagattccatatataaatgaaatcatacagtagagtttcattaatagtaaagtaacaatgtgggttgatatggtttgactctgtgtcccccaaccaaatctcatgtcaaattgtaattcccagtgttgaaggatgaaggaggggcctggtggaaggtgactggatcatcggggtggatttcccccttgctgttcttgtgatagtgaatgagttctcatgagaccttgttgtttgaaagtgtgtggtacttctccccgccctctggctccaccatggtaagatgtgcttgcttcacctttgccttccaccataatcctaagtttcctgaggcctcccagccatgcttcctgtatagcgtgcagaactgtaagtcaatgaaatgtcttttcttcataaactacccagtctcaggtagatctttagagcagtgtgagaacagactatcacatcggttcattagtagcaataaatctatgtaccataggaatataagatgttaataaaaggggaaactggatgcagggtgtacaggaactctgtattccatctgcaactttcctgtaaatttaaaattattctaaaattaaaaatattttttaaaaaagaaatcaatacacttaaaaataaacagacaaagtggggcatttgagggggctggagtaacattaacagcaagagagagagagaatcccaccctccaaaatatctaacacaactgagagtgttctgctaaactagaaataacagtaatttcaaagcttttaacaagagccgttcgcagatatactactagtaaaacctcagaatcatttgcttgttatattgttcctcctataatcctaccaaaaacaaaacaaaccaaaaaatccccataatcctttgaaagttattaaagtcatcataaccattagtaaaatataaatgtatctgccatacatgtctaataaacatgtagaatcaaatgcataattcatataacacttgcctctggagttcctagtgatttcacagcattcagatcagatcctgaagagaaagtattttttgccccacggacaatgaggcctttcccctctgtccaattttccaattcaattactttttccagaagttgtagcatcataacacctgccagagatggaagtgggaaatcacaaatatatgaaggtgactggaaaaacagaaataatttataaatcacaagtgtcaagcatactcttaggtcctatattttataaatatttactgagtgtctatcaaatgcctactgcactggcactatggagtatacagaagaggtacacatggcaggccctgcattgtaaatgtaaatttattatgtgtctatctctccatttatcttaagaaatcacataaatatatgattatgtagaagaataagaatatactatgctgtcctaagaataagaaaacgatatggtaataagaaaaaattatttcttagggtaaagataagacatagacctgacttctcagcaatacatgtctcagtcaataaagctttatgggtataacatgactatgagatcttatgatatattggacatatggtatacagaacaaaacacaattcctatactactgacatcagaattagtataataggatgttaattgaggaaatgagtaataaataccatcttgttccatggttaacaaactgtcctctgaggggcttgaggcatacgatggaagttcttcacaggcctaccaaccattgattctatgatttatagattgttaccttgatattactccaaaattctattggagcttctttataatagacaaatttaacacagaaacagctgggactggcattttaagatctaatcaataacttttagatatgcttatctttggtgatcttctaagttcacaaagttcatggttttcaacatgactagttttaatttcctctgcctaggcaatgctttagaagccaatgtataaagatcataacagcgggttaaaactggcaaaaaatttgtaccacaaggttccaaaagatggccccattaaattatgtacacttctttggaatataaatcccacaatgtcaagaactattattttctttgccattttctgaagtagccaggagtgaggtggctccacagtaaatgttatgttaatgatactaactcacaaatgactaatgcagctatcctttcttatggctaattatgacctacagtcatgcaccaacaatgtatcacatataccatggtggtcccaagattaaaatagagctaaaaaattcctatcacctagtaaccatcatagccattgtaatgtagtacaatgaattattcacatgtttgtattacagttgcctatagtattcaggaagtaacacactgaataggtttgtagcctaggagcagcaagctgtatcatatggtataggtgtgtaataggttatactatctaggtgtaagtacaccctacaatgttcacacaatgacagagtcacctaacatatttcttagaatgcatccccatcacaaagcaacaaatgactgcacttaaaactgtaaccctttccaaggatgtcctagatcctttagaaatatcgttcttttgctttcaagtgatatatagtctagtaagggaaagaagaaacccatatttttagtataagaataaatctgtataggttaatatgggcctttaatcactcataatatttaaggttctaaaaaacaggccgggtgcagtggctcacgcctgtaatcccagcactttgggaggccaaggcgggcagatcacgaggtcaggagatcgagaccatcctggccaacacggtgaaaccccttctctactaaaaatataaaaaaactagccgggcgtggtggcaggcgcctgtagtcccagctagtccggaggctgaggcaggagaatggcgtaaacccgggaggcagagcttgcagtgagctgagatcgcgccactgcactccagcctaggcgacagagtgagactccatctcaaaaaaagtaaaataaataaaataaaaataaataaataaaaaaaacaatgttggcctttgttttaaaacctttcctatggtgctgatttttttttaaacctttcctatgatgctgaaatgctggccatgagaataagaaaaatccataccagtagttactgttaaactaatcttttcaagtttgcaaagtaaacctcaaaagatggaagagaccttaaagagtatctaactgaatgatttttaaacaagggccttgagtgctcattcatcctctcccaatccaactccaccaaataccattacccaaatcaaagcattagttttatatattatgcatcaaaataatatgtttctaattgaataaaaaattatttgtaacttttcagaaataaatcatcactattgatccaatttaaccttctagagaaattttacctttcaatttctatttttcctggactaatattaaattggtttttattccctaaaccaactgaacatatagaactacaaagtctaataaggtagtcactagtcacctgtgtgtactgagcacttgatacgtggctagtccaaattaagatgtgtcataagtataaaataaataccagatttcagagacttagtatgaaaataaaaagaaaaatacctcataattgtttatattagtgacatattgaaaaaaatattttggatatactgagttataagtgaattgttaaacttaattttaccttttttaaatttttttaaactatggttactagaatatttaaaattgcacatgtggctcacctttgtttcttacattatgttttcattggtcagcactggtatagagaaatctctctgaattctggtaagtggagagaaaagtcatcttgggtttaaagactcaccactggtaatttacaaagggtttacagactattgaattatgtctatagtacaactgtatataaagtagatacatgaaaattttgtgagattttctgagcctcaaatttcaaatgctactaaagattataatcatgaagtgcataactgaaaaggagagattactaaaatcaacttgaaaataggagtggtgagtattcaacaaggctactcattagctcctgcataacacagtggtagcgtagttcaaatttgagcttcagcaaaaattacaaagtaccacatgtcctgcatcttcagttctcttaaatataaaattcttatatgctaagagtgttgactagaaaatagaaggcattcaccagtatctaagagttagggaagattccacagctggacaagtgccgtgtttcttctgtaaccatggaattaaaaggttaaaaactaacaatgattttatttcaattcacagaaaaaaattaagctaaataattcttttcattaacaggcttttctctttagtttcaggaactctttgaaacctctttctccttgtttcctagtagcattagctgaaaacaaatgaagttattaaacagttaatgaatttcggtggaaaatataatcaagattaatttagatttcctttttatcaatatctgtattaatgagttttctgaaaacattcaaatatccataatcattaaaagttacttaaagtgtttctagttcatattacagagttgttgtttttgttatttttctcatgttctaccaagagtacaaggactttaaaacattctgtcaccacagcaaggataaaaaaacttgtgataacagtttagatttagtgtcattctttaggaataaaaagatccctaatacctgaaaaggcattcattctacttggattgttcagagtaagaatgccaatgccattgtcttccttctgaaggtcaatggatccaccaggaaactgctgaagtgtttttttcacttcttcctcataaaatccatgggatgtactataaagtgacaatcctgtttgatgtagcaattttgtccttccagacagagaggctgtcttcaaaagacttttcgccatttct

SEQ ID NO: 8938 - DNA, 148 bp, Homo sapiens
  misc_feature (136)..(136): n equals a,t,g, or c
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaa

SEQ ID NO: 8939 - DNA, 130 bp, Homo sapiens; identical to SEQ ID NO: 7216

SEQ ID NO: 8940 - DNA, 143 bp, Homo sapiens; identical to SEQ ID NO: 7217

SEQ ID NO: 8941 - DNA, 116 bp, Homo sapiens; identical to SEQ ID NO: 7991

SEQ ID NO: 8942 - DNA, 151 bp, Homo sapiens; identical to SEQ ID NO: 7218

SEQ ID NO: 8943 - DNA, 202 bp, Homo sapiens; identical to SEQ ID NO: 7316

SEQ ID NO: 8944 - DNA, 1792 bp, Homo sapiens
cccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaccctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaac

SEQ ID NO: 8945 - DNA, 1342 bp, Homo sapiens
ctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaac

SEQ ID NO: 8946 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 8947 - DNA, 151 bp, Homo sapiens; identical to SEQ ID NO: 7219
  misc_feature (4)..(4): n equals a,t,g, or c
  misc_feature (45)..(45): n equals a,t,g, or c
  misc_feature (89)..(89): n equals a,t,g, or c

SEQ ID NO: 8948 - DNA, 118 bp, Homo sapiens; identical to SEQ ID NO: 7220

SEQ ID NO: 8949 - DNA, 77 bp, Homo sapiens; identical to SEQ ID NO: 7322

SEQ ID NO: 8950 - DNA, 6782 bp, Homo sapiens
gccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtggtgagtggagggagccggggaagcccttctctctccagcccttgcactccccaaactctcacttccccgaaggggctgtgttttccaaggtagcctggacccacctccccagctgtgacccccacgcttaaccgcggaggatcaagctgacttccaaagtcctcttccccacggttctaaccccctctctgacagctccgactcttgccagaatgacagctgttactccccagtgatagtgccgatcgtttaccctcccacaagtgactcagccaacaggctgggggcagcggtcacgcttgcagtctgggacagccagccacttcccctgcctcccacacccctccagattcccagaatcccagcccccagatgtaggggagggggcggaggcaaatgagccattattaggttatttgggtcctgggtgtctggcctctaatgaataattaagcctcaaaaagtccaaaggttgaagtgagtgaggacagtttgcacgagtgggggcagagggtgcaggccacatgggctgcgaacagcgaagtgggaagggaggcagattctgacggtagaagggtgggaggaagctaggcccaggcacagaggacgcgtgtctaaagttgctcacctggtgctcagcgactcccaggccctgtctgttatccagacagatgctgtcagcgtctgtgcagaagacgacaagcattctggttactccctggcctcttggttactctgtgggttctctgagtgagcatttccctgcctgagttactcctcagtcctagttactccttggtcacaccagtttcaccctggttttgttctgagtgactctgtttgcacttcttaggtctggcagacccaccagttatgttctatttcctgtcccagttactctgatttttcagccgctcatgtggttacacctgttttcctctgtgttcagttgctacattgcagtgagtgggttactccgttcctgccccagccctgggtagtacagaccagctggcccactgtggactaggaagcctaactaagggcaagtagggatccccaaatggttgaggatcaggatctatgggcagaggagggctgaaacccacttctggcttccaagaataggaagtggggaagccacagggggcattttatccacagcctcccataagattagtcgtcctatcagccagccctagcccctctctcctgtgccaagaaggcaataggaggtggcctttatcactctcctgcctcggagccctcactcctatcggagtcctgagtccagccacctgttttagagcagccaggctaggggaggatgatgtcttctattttcctagaggggcctcctcattccctcccaagtctcagttcactctctcacaaaggagccgttagtcctcccactgagccccaggatcatcaggcttatcccagaccacaaaagaagagtgttaaattttaggggaagggttgcagactcagatggatgtgaggtattggatatcagtgagaagcagaacttcaaggactgcatgaactggaggggcaggcctggggatccctttgtagtgggtgagtgcctgcctgcctacctgcgtgttgggagcctaggcctgcagtggcagaatcagggttggctttggggtgaggaaagcccctttctctgagatacctggtgtgagggcagggggcggtgctggccgagaactcagggcaggggttgggggaggaagaggaagattagccccaaggtggtggaactggctctgacagctcctccctccaaggcgtcctgggatggagccaggtctgagcctttggcaggcaaggagctgctgccagggcctcccaagcagggcagggcgcctcagaccctcacgtgcctgtctcccaccacccctcctcacacatacacctgcaatctctgatctttgctctcacctgcctgcacacctttgccccatgtcattgccgctggcttctccgttatctcttggtctttctgggatgataatcaaaatgcttaactatccagtacaacaggcactgacccgtcagaataaacaaggtctgtagcacaggtcctggaaactgcctgctctgtgggcataaaacctttagttatgggcaggtgggagaggagaccagggcaaggcattggagcagctttgagggacactcagggggctcagggcaacaatgctttacagctgctgcagaagtattttcaggcttgaacaaggggaacagacatagtacgttctttttcttttttaaatagagacaaagtctcactatgttgcccaggctgttctcaaactcctgggttcaagatcctcccatctcagcctccaaagtgctgggattacaggtgtgagccaccacagctggctccagtatgttctatatttgtagaacaccagggctcttagtctcttttagttcccccatttttggcagaaagtttagaaccgatctccccatttctacagccctgggtcccgggctggggatagtgagaggagccacacagatccctgtctgtaggacctccaaatctgagtggggaatctggacccctgagagcagagaggtcatgggtggagagaggagacgctgggacagggacaggtaaaggaaggggaggttgttgagggggacatggtgaaggctggggctctggcatcctggactcaggagaagtggattcaacctcacttctggtctcctccctatttatttatgccgcccattgccaccactaccaccaccacatgagcttttcttttcaactctttttttttttttttttgagatggagtcccgctctgtcgcccaggctgaagtgcagtggcgcaatcttggctcactgcaacatctgcctcccattttcaagtgattctcctgcctcagcctcccgagtagctgggattacaggcacctgccaccacgcctggctaatttttgtacttttagtagagatggggtttcactatgttggccaggctggtctcaaactcctgacctcaggtgatccacccacctcggcctaccaaagtgctgggattacagtgtgagccactgcaccgggcctacatgagcttttctttggggcagctgggggatgagtgagaggcttcccacctttatggtccaggcctgaagggctgtggagaaacttgtgctaaggtgaaagctgttcccctacacctacgcctgctgaaattcaaggaaaatcagtgaagatggttcagtcatcttctaggatcccagtcgcagaccctgcttccagccctttccatagggccctctcatattagagttgggacagtggggtgggaaggcatgtgtcctttttctggaaagtgcaattacagcagaaggggtttgggctgggttccaggaagcgcctctagtcctcccagtggtggcgagtgggcatgttgctggcttcaccccttccttctggagtgagagttgctggtcctcaccctccctgcctgttcttcttcctgacagatgtttggctgtggctccgtggcccaggttgtgctcagccggggcacccacggtggtttcctcaccatcaacctggcctttggctttgctgtcactctgggcatcctcatcgctggccaggtctctggtaaggccttaaccctgcccccagcccttggccctcaatagcattcccactaggtgtcctggcattcctaagggcaggtcacagctgtggcctctgctttggccccttgggaaaggagggtggagaagaaacttgacacttagaactttcgactctcaccttggaatcagagattatcagctgacctgttacatagaccaaccgccatcctgtgcaagaaacccctctctgcaccccttctcaggggaccctagcctgccgactgtggcaggctgcagctaataggtcccttgtcccctctgcccaggggcccacctgaaccctgccgtgacctttgccatgtgcttcctggctcgtgagccctggatcaagctgcccatctacaccctggcacagacgctgggagccttcttgggtgctggaatagtttttgggctgtattatggtaagcattccccaccctgtcctcctccactacccccgtccctctgttcaggacctgctggcaccaggccttttgatgacagacggctaggacctgcccaggccccgggctcatgactcactcattcacgcacagggtcaaggtagggggcacgaagggaaagaaacaagttgggcaataacagagtctcaggccctccaccccaccccacgccaccccctctgcctgctgcaatacagcagtattgctacttacccataactcatgggagggtggggagggcacacctgagagggaagtctgggctcaggcctctcccccgactcactgtgggtctaatctgtcaccagatgcaatctggcactttgccgacaaccagctttttgtttcgggccccaatggcacagccggcatctttgctacctacccctctggacacttggatatgatcaatggcttctttgaccaggtatgggctggggacgtgtgaggggaacgcagggaggggaccgagttgccttggtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgtgagtacagcccccacccagctcaccccagcctgcctctcctctgccctgccccccatgtccctgactatgagtgtctgtccccccaggaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctccagttgtgcaaatatctttctgcttgctctgctgcttttctggggccagttaaggagcttccgcatgcccacactgacccagggtgcccggctgagtgtctgatctggtcaggttaccctgggggtcatacagagaggttagagagcctcttcaccaaggctctcagtttgaactcagtggtcccaaactttcccccaagtttccgtcctcatgggtacccccagcataatgaatggaatcttcttcccaatccctgtacccacacatcaccccagaaaggcttgagccctatgcagggaagatcttgctgcagagctacccaatggggagaactgctgcccaggaggtggt

SEQ ID NO: 8951 - DNA, 299 bp, Homo sapiens
ggccgggcacggtggctcacacctgtaatcccagcactttgggaggccgaggcgggcggatcacgaggtcaggagatcgagaccatcctggctaacacggtgaaaccctgtctctactaaaaaatacaaaaaactagctgggcgtggcagcgggtgcctgtggttccagctactcgggaggctgaggcaggagaatggcataaacccaggaggcggagcttgcagtgagccgagatcgcaccactgcactctagcctgggcgacagagcaagactccgtctcaaaaaaaaaaaaaaaaa

SEQ ID NO: 8952 - DNA, 664 bp, Homo sapiens
ggacagtgcagctgtgatgaagccacagtcggatggaaaactgacctgagatctaagcgcttctccctgcatgagcctcacactcacttctacaagtgtgttcagagaaaattcaccaaacgccacaagtctgtgaggcatcttcacagaaagccagcttcagggaaacagcagccaggccgcgtaatgaaggccaactgaggcagcccccggggtcagcctagcccagggcttgggccctccatcatggagagtggtcaagtcagtctgtttggtttggttttcagtctgatgccatgttgtcagcacattcagaagggagcagcttgtcctaagacagtgaatctcaggaggccacagctgtcaggacttttgatttcctggcgattcctcaagtgtattctgctggattttaatgggtgggtgtggaaaagtccctaattagatccatttggaaatccctgagtgaaacaaagtctatttttattgcgcacctacgagccagcaggagaaagctgtgtgcttgtctctttgcagcaatgcagctgacctcggaaatgatgtccaagaatgcctgaagctgagatggaaagtggcagcacctactatgtgccaggtgctctggataaagctgcaaaaaaaaaaaaaaaaaaaaaaaaatgga

SEQ ID NO: 8953 - DNA, 24387 bp, Homo sapiens
cgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagtcggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggtgagagggtgagggagccagcgagccgggtgggggaggggcggcggccccggcgcgaggccaaagcgcgcggagaactgcccaggccgccgagctcctccgcgcgcacgcgcgctcgacgcccttcgctggcgcggacgccctcgcctcccttcccccttcccgccgttcctgtcgcgcgcgggcttcacccccccccccgcccctcccccatgacaacggcgttcgcagccgcctgtactcgggttcgcgagcgcccttggtgaggggggagggcgcgcgcctcggcttcactcctccccccaacatgtgccgccgaggtggccttcctgcagctgccgttttcggcccttaagtggcggggaaggggcggcggcggggggcttgctcctggacccttgcccccggttccagatctcctttcctcgggcttctcttcggcgttgggctgcccgtgtcgggggcctcccagactgcgggacgccgcgcagccccctcccccattccgcaaggccgaaaataggcccccggcgctgcggggagggccttgaacttcgtgggccggatttaaatggtttaggattcccggctatcagcctttgagttgttagtggcggggagaaaccccaaatcttaaaaactgtgaagaaagtgaacgtgttcagtttacatttgtaaggtagaccgtgcgttccctttttacactttttcaacgtctcccgagaattcgtgttcaaactaaggaggcttttggagaccttcgttgggaagaaaacgccagactcatatataagttttctggttggtttcaggcgttctttggcacacagctcttctgaagcttggtttccactcggcttcagttaggacgaatctggatcagaatttcagagtgttgtgttgtctttcatcctaagtgcgtgggcttagggctcttcaaaagctactattttagctttctgggttctttgtgtccactcagccgctctggagcgccccggtgctgagctggctgtgcttgctgatgtccatttttttcgacaacccttgtctcccctttttctccccttttggtaccgttttcttttttgcatattttactgttgaatttaaatatatctttctacttcattgttagcttaccactcagataatttcccaacagaaaagggtgtttttgtcttcctttgtactttttactttctgcttttaacttgggtaacttttgcatatccactgtctatggcccccactttaagagttttgtaatatcgtttggtttggtgatttgtgtgtggtgttgatcttcctactttctgtgtcttaacacaccccttagatgccgtggggtcgtcgtctttttttgtggggtggactaggtggctcattccctaaaagttctccgaaacattgtgacctaatatcctttgcttagcacctactggtttttcttttttttttttttccgagacggagtctagctctgttggcaggccggagtgcagtggcgcgatctcggctcactgcaaccttccgcctcccgggttcaagcgattctcctgcttcagcctctggagttgctgagattacaggcaatcgccgccgcccagctaatttttgtatttttggtagagatggagtttcaccgtgttggccaggctggtgtcaatctcctgatctggtgatccgcccacctcggcctcccaaagtgcaggtgttacaggcgtgagccaccgtacccggcctggttttcctttcttaaggagtggggggatttttgtgtgaggtggtatggaagtgtgggtgaatggttaagctgaagaattaagtgcaggtcaaaaacatgctgcaggggaagcagaaattaagtggggtaggggagaggcgaagaaggacctagttttaaaccgtgaggaggattggtactagaagatgaaaatgaggattggggtgtagagaaattgattttttgagccatacagtttttcattttttcctggatttctgcttgccttatccaggtttagcctcttctgtcaccttctgctttcaatattgggtctgctactgggcttgggtagggacccatccttaggcgcatgcgctagtatatttttccaaacatttgtatgatgcttcttcattctggaattttctaaatgcatccttcccttctatccagttcttttacatctttgattactctctccgctttacgtattccttagggttttttcttagtagtattttctcatatatgcatgttctaggaaactatcttggagaggatgagggtgagaaagagagtatatgtaataggagaaaggaatagagtatgtgtagccaaggaatctaaccaggaaagctgggacttgagaatttttcagaatcacgttagggttgggacaagttgaaaggctagaacctgggaggaggcatggggttaacacaggagagaaggaagaggcagggctgagagagaaaaactaggaagtgctatccaggggattggtggggaaagccaacggttggacattaatgaaagtggggtgtagagagggtttctacatagatttagggcaaggtatatggagaaggtatgggaacggttggaacagaggaggctggtttgatgtgtttaaatagagcagagttgaaaacaggtaatatttgacagctggcaagacagggaggaactgcaaattgttgtaaatcctattgagaggaaggaaattgaaggaataaaatatcaggatagttgataggatctttaaatatttggaatcaaggaaatggcccttacctgggaggtgaagtatatgacgattatccaaggttcatgtgtgtttctgatgtgcatgctggcctttagttggggtgtgaggctgcacattctgaaccaactagtctgctgttcagatacctaggggctgtgtagtttatttcatattcgtatagggtggtctgaaatccttaggtaagtttttgggagagtctttggacatggactagaggccgttgggtgccacagatctgtgtctggtgtttgttgtgaccaggaggctttggttggttaccagaggttaggaattagagtagttggtaaacacaccacttgtgcattttggggccaaaggagaacaaaaagggacagtgtggagagattttagaggaacaagatccttgtttgcctagggtggaaaaagaagaaaatttaggtgtagggagggattatttagaattctgtgcaagggcattgagagaaaggctgtaagaactgggctgtgatttggtagaaaggaaatttggaagggcaaagaagtggttttcttgggagaccaggaggatggtggagcattatacagcgaagacttagtgtgaagatcaatgttgaattagggatgaaggagagcagggacttgggtgtggggcggtaagtggttagtttggggccaggggcctgacccgtgtctccccgctccccctcaggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtgagggagagctgggggagagtcaagcactgaatgagtgcagagctgggggtgttaggtgggatgtatagggagcttagggtggttgaaagaggcctggcaaagagttgtggtaggggaggaggcagatgagctctagagaagtgaaaacagttaagggacagtgcagagtgggaaatgagaaggctgtgtgtctggggcatagatgggagcctgaggtactaaatggaggcacgtgggagaagggaggggccattgaggaacaaaaatgtgttttaaggaagagatgggaaagcagagaccaggtagaggagctaggtaagctgataggtgttgtcattggtagaaaagaagaagataaatggatgtaaggattgaggccttggaaagtagcataggcaggaaaagaggaattagaagaatacgtgaagaagtgggaatcatgggctgggaagggaaattttggaaaaggagcacattaaggcagaaaactcttttagagcagtggttttaaacttcagcaatggtgatccttttatacagtatcccttactttggaatcccaggaagtaaaaggcacattcttgttgaagttggggaggagcacttggaaccctgcttgcttaacttttttcttttggtccctgaggtgtagtatatttaaaatccactgttctagagggagtagtaagtagagggaagaaagatgatgggaaaagatcagacagaagggacttttgggtgagcgaaaagttctgtgtgcgcatggagagggaggggccccttttgggaatgagggaaatggaaacctgggactggggaaagtgtcctgtcgagcttaaccctgaagggatttgttcttcaggtacgaggaacagcaaattcaggaaaaagtggcgacctttcgactcatgttgctggagaaggatgtgaaccctgggggcaaggaggagaccccagggcagaggccagcgtgagtgttgcgctctccctcgatgactctggactctactctggctgctggctgctgctgctgtccttttccttacgtgggacttcctccctgctttcgtctgcctttcccatgccttatttggctcctgcttatacttgtgttctgaatatggctctgtcctttatatttccttcagacttttgcccttcttttctctagggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacaggtatacaaggccaagaaaccactgtcagcttcttttcttgattgtaagctccatgctctatttttgtctttttgcgggctggtttcttcccaaactcttcagattttgttcttctgaagttgaggtgtccaaaaaaatttgtccaagggttagtcacagtgggtcacgcgcgtaatcccagcattttgggaagctcaggcaggagatcacttgaggccaggagtttgagaccagcctgggcgatgtagtgagaccccatctctacaaaaagaaaaaaagctggttggtggcacatgcctgtagtccaggctgcttggagaggtggaggcaggagggtcttttgagcccacaagttggaggttacggtgtgagctgtgttgctgccactgcaccccacctgaggcaacagagcgagattcttatttttttatttttattactatttttttagactctgtcttttaaagaaaagaaaggaatgtttgttctaccacccatctctgctgcttttcatttttccctagccttgttcgggagtctagcagttctcgctcaccaaccccaaagcagaagaagaagaaaaagaagaaagatagaggacggtaagttagttggaaagtgactctgatagccagaggaccaatcctgtggtgtacctttctctctggaagtggacagttctggcttccacaaagcaggagatagttgtcagggaggagggagttaccattgaggcctcaactagaagaaatacctgagtttctcagtggggaagtgttgagtttgcagttctgctaattaagattggccagcagcattttggattctggaattttctttttcattttgaggtttgttgacttaaggagttacttgtgcttgttggagaaagaagaaataagtcctgggcttaggtctggggcattagtgctattaggacattcaagtgttttagaaacctttttaggagagagattgtaagtgggagggccaggaaagaagccaagcaggatgagcttgcttttgaatccatctttagcaggtcagagagcagctctcctcgacgggagagaaagaaaagctcaaagaagaagaagcacaggtatgaggtgggaatacttgaatgactggagaaggtttgctgaattcaggcagaggtgtttcttatgttttttcttctcttttttccaacaggtcagaatctgagtccaagaaacgtaagcataggtaagagctctttaactcatagggggcgcagtggcatgtggagtggtgatttttttttcttggagtgaagctcaattccttgatcttccttgtgtcaacactccctctttccatttcacttttggttttatttccttttttaaagaagttacttttaacaacctttccttatttcccaggtctcccactccaaagagcaaacgtaaatctaaggacaaaaagcgaaagcggtgagtgaatttgtggggaatttgcttaggaagtaagtgaacgccaccttagtgggagggagttgaatgagttatgtccctgactggtaaagggttgagggatacgtgaggagaatccagggcaggtacagcagtaccctgagctgtggtggtggtcttccttcaggtctcgaagtacaacaccagcccccaagagccgccgggcccaccgttcaacttctgctgactctgcttcctcctccgatacttcccgcagtcggtaaggggtagtccaggaggaagggagggagagggaatgatgggttaattaatttaatatttattgagcgcccacggtgtgctaggcgctgcacagaccattcggaagacacggtccctgccctctaggagctgacaggctaaagcaacaggatggacagacatatacatttccccttctctttttttttttgtttttgtttatttgttatttttgtttcgttctgatgtatatggactgccagaatagggggggtggtggtttgttcgtggtgtctgggggaggaaggaatccttaccctggcttccttaatcggggaaggcttcctgaaggaggtgggctcagaggtgagttgtgaatgaagcgggtagggagtgggctgggtggatggtttggggatgtttgggggaggtgagtaaaggggtagagggagaacgctctttgggattgtgttgggaaaagaagaaccaaagtggactgtacttgcatttcagtgaatgatttgagttgtgcgactaaaggctttttggaagagggttgtccagttaggaaaggtggatgggagttggggagggggttttctgttctccctttgagctgatttccttcctctcccacgtcctcaattaactcctgcaggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggaggtatgttcctgagttggtgatgttcattggattgcaaatgtatagatttaggatagacatgtgatgtgaaagggagaggtaataacttattaaaataaataaattcagttttttttcctgcagttctctcctagttctcttactgcatctgcagaacttttagtgttgttactagactgaattgtgaaccctttagaatcaaatctcactggatgttaggttttatattgtgtcttgtttatacatagatagaactggaacaaacgttgtatcttatctgtgtactccgtatgatgcctctagtttcttctcttttttcattaaatgctggtcatgtctcaccaaaactttttaatccattgggttgccaccaatagtttgaatgaaacactgaaatagtcttcagtagtcttctgttccaattttaagcattaatcatttcctcttgctttagtgattacagtctgaattcttggcctctatcatcaattttccatgtcatccagggttacctttccaaattacaagttggttgacctcagaaacttaactacttccttattgcttttgaattatatttaaggcttttaatagtctggtctttttctcatttcctgtactctacccatcctgggctgcttttttactcttcacacaaatcatgttctcacatctttcttcatgctgtttcttttcgtttaatagagttattcttcaaaggtgaagttgccattcgctttaggaaactgcttatttttccatttaaagatagtttttttccattcttataacattttgtagtggtatttgttaaatgtagtagtgcattagttatttgcattttgtgtttcttttagttttaagattctggctatccatatattcatatgttttcaccactgtgctttatatgattccttgttattgaatgaaagtgatcgcttgtggtcagagggtgtgtaaaagaaaagttatcattggaaagggtgttgggatcttaggggtgatgtgaagttttggcgtttatgaatccctatccctgctctctcttccactcttagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaagcaaaagtcacagacaccacccaggcgcagtcgctctggatcctcccaaactaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagagaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacacgaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcctcttcatcatcgtcgtcgtcgtcctcctcctcctctggctccagttctagtgactcagagggctctagccttcctgtgcaacctgaggtggcactgaagaggtgagggagcttgacttttagaaatcttcagtgggggaggtattggggatgggttggggagtggggagggagaaaccatgtcacaggtgcttggctcttggaggaggtatggggaccttgaccctcaagctgggggtagaagagaatgctggggcagggggcggagggaggaggaatgggacagataaaagtctccgaaggttcattctctagaggataatgataagttttccgtctctacagaggacagaactagaggaaatggacttaattttacagcaggagggatggcagttagacctcaagaggaactccctgggctggaaggatcttcagaggtcatcccatccctctccctgcctccaggcaggacggccccttccccagccaacctgcactcacaggggcctccccaagctgcggctctccgaggaaggagacgacccagcttcagcttccacacctgagcccagaggccttattcctccatcagggacattcttgaggtttaaccttgatcccttatgctgcgggccccagcctgttgcttctgttagcagaggttgggtcagctcgcaccactgctctccagagaattgctggctcacgtggctcggagagctcccagcgcctttctcaggcacccctccccccactgccgttcctccaggccaaggaaggtagggttggggctggggcagcttgtctccttgtgacactcctctcctcccacagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtgagtgctgtcttgcctgagttgaaaggtgggtgggggagtgacttgtccagagaaggggccctggggtgtgagctccccgctgggtgtctcacgtggccttgggcatctggttgtgggggaggaggcacttgctctcctctccccatgctcgttgcaccctgttctggcgaagggctgcgccatccacagcggcgctcaggccaggaccagggggtccttggtttcttcctctccctccctcaacacatagcctgttcccagggttctagctttgtctccctgttgctactgccagggctctggtctggccaccatcatcttctcccgactctgtccacagcctcctccctgtctccccgtctccacgccattctcttccacatgtagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatggtgtgcgggcggatgggtgagtgagcggacaaaggtgggtctgaggctggccctgtgtggtgtgaggtttggtggtcaggacctgggcgggtggtcctgagtgctggcccgtgtgcttgaaagggtgtggtgctattgggtcctactgtgttccccaggtcccgcagcccccggaagccaatagactccctcagggactctcggtccctcagctactcgcctgtggagcgtcgccgtccctcgccccagccctcaccacgggaccagcagaggtaaggccaactgcaggtgtcagcacccagcctgtctggccgccactgctttctacaaagaagaaagctttgcggttgtggctatgtggtgcctgaggtggtgccaccctgtggcctgatgtctgtcctgtgttgcagcagcagcagtgagcggggttcccggagaggccagcgtggggacagccgctcccccagccacaagcgcaggagggagacacctagccctcggcccatgagacaccgctcctccaggtgcgtgtcctggaaggctgatgcccccttccgggagccagttgtggtggtgggtggcggccccattttgggagtggcccagaaactggccttgagggctggggtgggaactccctgttgacccatatcttctcttgcaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcaggaactgggtctgtagactgtttattaaaggtgtgttaagggggcagccacttccctccgtgattacagcccccagcgtgggtggacctgtgtgggtccgtcttggggttccctcgttgaacatgctgtcaaaccaggacactggctccagcttgtgtttctgctcttggccatcgtctgggagtggacatgcaggctatgggggtggggggcacttagaaggagaaaggcctaaaactggaatctcttgtccctgaggctggctctggtctttgtgtctctcccagtccttccctttcctccccctggcgtggttggtgtggctggctagctgctaacaatggcttgggtctgagggcaacccaggtccccatggtgcctttaagcagcaggctgggccaagttctcagccagggtctcaggatctgggagacaggacagcacaggaactgccaagcacaagccccaaaaggagcccacagggagtgggacccatcccagggaggggcgggaaaaagaggcagcaaccaggcagactcccaaatctcttttattgggggaaatgggcctcttgggggtctcactgcacggcttgttcattggcactgcttcccgagtcctggggcttcatcacatcgggcagctctggcgggctggaaaacggctcgatgcacagggcctcaaaggtgtcatctgtggaggaagcagcagagctgcaggggggtattccagctcttgccccagctggggccttggtgttcacgtgtgatcatctgcagctttggggatctccatgcgaacgcccctccacacggctgtagtctccacagcgctgacctccctgttccagctacccccgtggccccacggtaatgtctcctacccctgtgggcccaacctgaaggtccccagcccttcccactgaccatgctggggcccctttcctcatcttccatgtccactagtgagtctgagggctcaccatctgcagccagcatcacccttcacccagaatatatctccttgttcccttcacacactttgggaggccgagacgggcagatcatgaggtcaggaggtcaagaccatcctggctagcacggtgaaaccccatctctactaaaaatacaaaaaaaaaaaaaaaaaaaaaaattagccgggcatggtggcgggcacctacagtcccagcttctcgggaggctgaggcaggagaatgacgtgaacccgggaggcggagcttgcagtagctgagatcgcgccactgcactccaacctgggcgacacagactccatctcaaaaaaaaaaaatcaaactagactatctagactattcctcccctgctgaaaaccatccagtggcttcccatcatgacctgaataccaccaagtccttgccgtctgtctctccctctgcttcccacgctctcaggctctggctctctatgttctgtaagttctttcctaactcagaccttcgcacttgctggtcccagcactcggaatggctggctgcttctggactttcagggtccaactcaggtcacctcctcagatgaacctccagtccacgcacccccaaaagtcaagacatcctgacactctgggcgtaggggcacttaccactggacaaactgcccttttgactggctccaggaaggcaaaggccttccctgtcttgtccctactgtcaccccaacacacagcaaacaaacccacagcttttctcttgtgctttcttccagctaggagacccatctctgcttggctcagggttctcaactgatcaggcatcccagggaaagctggaatgcctgatcacagttgtggcggtcacaaatggggaggtggggtgctccagcgctatctagtgggtagaggcctgggatacggctccacgtgctatggtgcacaaggcaacccacacagcaatccagcccaatgtgcccactgtgccgaggttcagaaactaatccatcttccaagccacaaacctgtgacaattcgtgccttcactacctccctcattcttttgtgatgagccgggacaatgccctttaacatttgatttgaaatactcatctccttgagtggtaagcttgggggaggggagaggcggagggtggggcacccattcaaggcctgggaacaacatgatgacgggttgagctgcacccagaagtgtgtttctgcaagcattccatggggaagcaaagagctgacagcccatgctgtgccccctatcaagacagccatcacctgcaagagggatgatgtgacctgggctccggagtcaccaccacattccatgccatattaggggttgtgggagaaaaacaagtcaccttccttagccttcattttctcatctgcaaaatgggtctatcagtatcttccaagtcacagcaaacctctaggggtaccactgttgaaattagagaaagggacacttctgggggaacacagcccagcttcggttcacgaagcagaccagatatgctcttggcactcccctgctctcttcagacaggcacccctgggccaggcaccgaggctcaggcctgtaatcccagcactttgggaggctgggatgtatggatcgcctgaggtcaggagtttgagaccagcctgactaacatggtgaaaccccatctctactaaaaacacaaagattagctgggcgtggtggcacatgcctgtaatcccagctcctcaggccactgaggcaagagaatcgcttgaacccgggaggcagcggctgcagtgggctgagatggcaccactgcactccagcctagacaacggagtgcgactctgtctcagaaacaacaacaacaaaaatgcacccatgtacaaggcacgacctgtgtctatgccagccctgcacctgactcttaacatcaccatctgggcagaaagagcccacagaaaggctctgaagcttcccatctgttgggcactggcagcaggccagacctggggtgcatgaggactcaacaccaccttgctgtgaagccagtctcatcacacccctttaaggagaagggaacactggggccaggaggggcaggagggcaaggtagctggccagaggatatagctgctgagactgaggcctagcctgaacttacggaacggaaaggtggagctaggactctactcttcctcttcagcctttgctatgttcccttacaggcagaaaaataagaattccttacaactttatccaagttttctcagccatccacacagctgctgggtccacagctgtgaaaacacagctctataacctctcttcaagttcctagagacaaaatattttaaatctcccctccctttctcttgggtggaagaagatatcttggcgagtagtaaaccactccctaatccccaggtttctaaagcttgggcagggtggggtatggctgatggaagcccaggctctggatctgaatcctagatgtggcagtcccagcagatgacctaacctccccaggctcactttactgaacctgaaaagtggcaaaatccaaatctcagccacacagagatgcagagggtttcggtgatacacagcatagagcctggtatgatgtctgactccagcaagggcccggcagtcagcatcctaaccgtggctccctacgtgactgctggtaagcctgtgtcctcatctgcagaacacggatgatggtatgtggacttcccagggctactgagaggatgagacagggcagtggaagccacacacagagtaacatgcagagcacggagccaggcactcactcagcctcctgtaaatgtgagctggcttcacaaaataagctttggtttctgtaagcatctcatttggttgcttctttttaaaaaaaaaaaaaatgaggaaacaaacacattgtgaaaggatattgccagccctttaggcacgaggaagacactgccctgaaggcttcaactccaggctccctgatgaccttctttggaacagtgttcccaacctgcttggctaccacccagcccagtgggtggtgggcctctcacctgcccggaaggccagccccactgtggctggggcctgtggccgtgctgtttgactggtgaagccacactcgcccagtgtcttgccatcatccaagagttggtcatcctgaggagagaagcaggatcttgggagaggccctacgtggggcaagtcccaaagacttctgaccagcaactacacgggaagtcagaggagggaagagagagttccctcagtgtggcccaggaccaccacgctgcttgacaaatacacagattccagggttatatccaagaacttctaaatcaaaacctcccagggtgggactttagaatccggttttatccaaattctccaggcaaatctaatttgaggagccactgaactatctggagataggcagacctggctttcaatcccagctctgtcaccctggactaggcatttgaacatttttttattttagagacagggtctcgctatgttgcccaggcatgcagtggcacagacccaacataagcgctatcatagccccctccagcttggaactcctgggctcaagcaattctcctgcctcagccttcagagtagctgggactacaggaccatgccaccacggctggctggtagttgagccttttgatgcaaagtttcctcatctgtaaactaggaattaccagaattctcaattcgtagggccaccagagggtttcaatgagctaggaagaaacataaagcactaagtagacatgtggcacacgggacatgcacaggcacggtcatttaatatttgctaagtcccagtagttatgagtgaggaaaggcctttagagaccatgggagctgaggctctgagcctggagctaaaagtcagtttcccagtttccagctctagaatctgaacaatgcacttgggcgacaacctcacaatgttgggagacgtaaatcagaggctgatgcatctgactccccaatgcagaccccaaaccccaagccattctgactgaataatctcagttcgtttgcaaggggaaaggggggcttctaggacatcagcaggaggtcgggaggtaataacaaacggttgcttggtgaagaacgagtgggacctgactttctttgcattcactgagttccccaccctccacccgaaggagtgtccggggggacagcgtgattccgatgggcctgcgaagaagggtggggattaaggggtcgtggttcgaaccctggcgctgccaatgacctttggctggttaagcgaccaagccgaacctcaatttcgtcaactgcacggcgcgggcgataccgttg

SEQ ID NO: 8954 - DNA, 942 bp, Homo sapiens
atcccagctacttgggaggctgaggtacaagaattgtagtgcgtggagatcgtgccactgcactccagcccggggttaggagtgagactctgtcccaaaaaaataaaatagacaaaagacacgaagagaaatttctccaaagatgtacaaacggccaacaagcacatcaaaagattctcagcatcatcagtcattagggtactgcaaacgatgttttgtcactattcacgggcattaaatgtgctgactcacgcacaaaacattccataaagaatatcagtgggggtacaggaaagggtctcactggaggtgctggggtctttaaccagaaaggcaaagcctttgccactttactatgccactccagagttgcggccggcttacagaagcaccgtccatagatgcagagttcagacactccaatctgcgatcagagctcctgcaggagatgggggtggtgggggggagggtctcccggctctagcatctgagataagtacatcctcccacgggcaagtgaaaaacaaatcttaaagccggatgcgggccgggcgtggtggctcacgcctgtaatatcagcactttgggaggctgaggtgggcagatcacctgaggtcaggaaatcgagaccagcctgaccaatatagtgaagccccgtctttactaaaaatacaaaaattagccaggcgtggtggcacacgcctgtaatcccagctactcggaagactgagacacgagaatcacttcaacctgagagacaggttgcagtgagccgacaacacaccattgcactccagcctgggtgacaagtgcgaaaccacgtgaaaaaagaaagaacaacaacaacaacaaaaaacaagggccagatagggtgtcatgcacgggtagtcccagctacttgggaggctgaggtcggaggatcgcttgagccccaaattcgag

SEQ ID NO: 8955 - DNA, 7176 bp, Homo sapiens
agttttacaaaacgcgatttgtaatataaactagttagataactcagagggttttattggccatatttttgtttatgctttgtcacaggctttagtcattgcttccatgtgttttcatccttcaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccaggtatagtgaggagtcagaagtgtgaaaacattaaactattgtaattttttctgattatgaaaatgagctagactaggcagagaaattaggtccttagagtttgtcatattgaaattaaatagatttttttaatcaaagaaaaattgaattcaagagttgcatatagccagaacattttggaggctaatgtgagtatttatgatttaggtattataaagtttggagggttatggattaaatacaatttctaggcccctcaatactttttttttatatatccaaacttgagtaatatacgaactcatcttcatcattgcaagcaaaatataaacatttgtgattacctgtcagttttcctttatatgtgatccctgatcaatcctattttaatttttggttttcagttttttctttcaaactatacagacatgattcaaaatgaaagattacacctacacatttaagttggagctttagtattttaatattttattgaagtaaatagtatagaaaagtaaacaaaaaaagtgctgtaaaacttgtaatttctttattgctgtgtcatttagccttctaagagaactagctctaaaaaaaatatatacatgatttaataatgtattcatttccagagaactttgtaacctttttttatttctaaaacaggactaagatgttagaacaagttataaaggaaaattttatcaggatagattcccccccttccccaaggaaatgcaatttttagatggtgattctagacctacaacaaataatatagtatttaaatcttttggctctggtagtatacatacagattaatagaatctccattattggactaattcaaaaatattgcagagcataagaaccattttaagatttagtttagacttacattcaaaaaaatactgctttgttgctttttcttagacatgcaggagaggcctgttttgcaattcatcctagtaaacaaaggctacctgaagcaagggacctttaagaggtttcagtgctttgtaatttaagctgagatctaaaggctaactacatcaggaattgtgtttgctgtgagctgtgtctgtggctacttcctaaagtggaaaagacagtatgaacatgtctaagagcagcatttatatgtttgtgttaattaaacaaacttttattgaacatctgtgtgccaggcactgtagtaggcagaggattcaaagaggaataaaacacatctcctgctttcaaggaattcacagactagtagaagattcagaaaatatcattttaaaataaggtatacttacaagatcatttactaaattattaggaacaaaaacattagctgtaaattacataaatataattgtggtaacattttagaagaggttctatgttaaagcaatctgttttcaacttcatttctctctttttttttttttctacagttgatactctagtagcaatttttttgtctggctgagttttctatcttgctgcttcttttttcatgaacacgtggagcatatccagtcttacctgcttttatttttcttccctattccaaaaatgatatatggctttatgatccttgcattttctgtcgtttaacttccagcagtacatactggcaggagctactccaggaattaaattttcttcctgtagaaactcagtctctcccctgaacttcgtatatagtataacttacactttattgaagccaaactgaagcatgttattttattatcttggcctagaatgcatgttgagttgtgggagagctagtgttcattccatgttcagaaacccaaactgcacaagaggatgtcccatgtatatatgcaaatataatcacgtatagcatgaacattggaaaatgaggaaggcagggaataggtgtagcactaatgttaccaaggacaggttaccacataataaatacaagcttgcacacaacatatgtggaagaccttttgagggattctgactaactggtctggaataaaatgtgaggattgtgatttttcttttattttatcccttccattacacaattctaatttgcaactagatttgaaaagtcattgtttagacctatatagtagtgtgaagttttcaaagtatcttaattctttccaacttatttccctagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgacacattgggctagctttaaagagaaatggtacccaagggtactattcatgctatgcacttgtttttttgcatttaaaaagaaaaactaaaacactttttaaatcttttctccatgccacctgagtatatgaagtttcaattcaactcatatcactgtttttgaaactcttagaaacttttcttttttaaaaaaaaatttcaacttttagatacaggggtacatgtgcagtatacccaggtagtgagcatagtacctaataggtagtgttagaaacatttctttatgtttaacatctaattactgttttcagtttttggttctcatattagagctgtcctacacttgcactatttcataaataagcatgttttgattttacatcattttttgaaagcatataaaacaaaacacaaaatttagactaggttattctgataatcacaccaaaaaaaaggtagtaaaatattttgttttggtaaatggagcattataatcttctaatagcaaagctgttactaaattttcaaaagtgtttaaaagtgtttgacagtatttgacagcttcactttgataataaaaggaccgtataaatttttttgccttaatcttttaagcccagaaagagaagcttgggtctcctttttaaagtattgccaaatatattgttggcatccaataagttaaaatcaaaattacagggaactgattaatcattaatccctgatgtcttttcaagctgttgaaatttgcattcaactccaaaacaagctttcttgtggtttgcttctctttatccttttttttcaaaatacaaaaaaattaaggaggaaaaaatattagtaaaatggtgtctatagtttaaccaacaatttaagattattttcatagataaactaaacatattaagatgcaaccatccttgagttctctcaggagtatgacataattacttaatagtgtaacccataaataagttactcataaatattcaatgaagagagttctataaagctaactacaggattaataggtcagattaatgctaagtctaacttaaaaatctgcctttatagcaatatgcaaactgaccaaaaactgagagtaagatggccaattcagcttacatctacactttttaaatcacattaattaagccaacattatactagacctaagtagagatataatttctgatgtcttgaaactgagactctagaacaacagatgaaacagtcaatatcaaacaccaataagattaactctaggtgattgatttactttagggaaaagtacatagtgctaataataaacatttatcataaatgaaaataagaagtcatttattgtccaagaagcatggcatcatctgcagattaaaacaaaaccaaacctttggacctggctggtcagtagtaggcacaattataaatccctcaatataagacagtttgctgaaacttcatccatttatattctgagatgtggtgttggtgatacattttatctaatatgtgaagttctcctctatttcagtttattttttcaaggaaaaaaatcttgagggagaactcttttcaataccaaacattcaataatatcagttactgcagaactatactttattacaactcaaggcttgttagagtccagattctaacatggcatttctagaagaggagcccctcaaccagaaatttggatgaagtgcttaaatccatgaggcccagtagtttgaatggtcactctgacatcatcaagtgaagatagtccatgtagagattagagcagaaatcatttcgggcccaaacccaaggatcacaaatgataaagaaatattcctcttccagtcaccaagggtttccctttgtgcatactggttgtccttggatatttttagaattgtccctaatatactctgcactgccagtgctctgggtagcatttgtatgccgcatcttccacattaccatgttatgtgttattttcactgccatcagaaaaccatttaatttttcaaaattaatttcaggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacacactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaatgtggagaaattggagcaggaaaagaaattatcaaagcaatagaaatagcttggtggtcctatggtgtttttggaagtatttggcattgctaattgagcagtccatatagtactacttttagaagaaacaaaaagtctgttttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatg

SEQ ID NO: 8956 - DNA, 140 bp, Homo sapiens
tttttttttttttgagacggagtctcgctttgtcgccctggctggagtgcagtggcgcgatctccgctcactgcaagctccacctcccgggttcacaccattctccttcctcagccccccaagtagctgggactacaggc

SEQ ID NO: 8957 - DNA, 14162 bp, Homo sapiens
cagctcaaatcccagccttctatatggacacaagtcatttattcaatacccaacatgcacgattggctccgccatccttggctcaacaacagggtttccaaccaggtctctctcaggtaatatcaaagacttcttccatcctgtatttgttccttcgcatttctgtggttataatagttatcttggaacataaataatagactctgaaattacaagctacccacgattagcttgatattctataagcaaaatttaaaatttttcccaaatttaccaaagcttgatagtaataatgtagaataagtagtgggttgaaagggaaatttagatgtttacattcagttttgttttaaaatggagctgatatatagtattaatcttactcttttcatgtctcaaatttttatattccagtgttaatgatttatctgtatgatgttgatatatatgtttacatactttctcaatgcattgcagccaacttcagttcagcagattccaatccctatttatgcaccactgcaagggcagcatcaagcccaactgagtttgggggctggccctgctgtttcccaggctcaggaattgttcagctcctcacttcaaccatataggtaaatgctttaaaagttatgtttgtaatgatgttgaaaacattgtaactgctgatcctccttgccgtaatccatactgttccttcccaaaaaaacctaggatgactctgctataaactacattggctaattgagcatgttgattatatgtcatgaacctcagcctctggtaatttcaaccatatcttattaaagaatgtcaggtttcaaaccctcttgaagtagtgaacaacagcaaccccaaaactgttagaaattatagaaagtagctgctaaagaacctaaaagtatgtgtgccatctggctaccaaaaactataaatctgaatctcctctatgtacgagctgaggcatggcagttaactacatcatgttagggggtgcagggcagggtggaatataacagaacagagaggggtaaatatcaaagcatggaagtaatgatgataaatatgctgtgtagtgaagaaagcattttttccaaaaattcactcagatgcactgtaagttacctttgcaactagggaaataatgaaaactgatttttattgaactttccttatatatgatagatattcagcctttcacatacattaactaaatttagtcttcacacaaccacctaagataagtcaccctcatttaacatgtggatgttaggacttgaagaggttgaggctttttttgttttgttttgttttaacctgaggttatacataaagtggcagaccctcagtgtctctggtttccagtttaatgagggaagaagagtgagtaagagtcagatagtaggagcagtgcatcatggcatagctgtcatccatactcatgatggtggccttaaatcatcataaagaaaaataagttacattcaggacacttagtttaggaaggctgtgcatttgtttttaggaatttgttttcagaagtgggttcagatagaatttctatactttatagattaaacctgtcatcagttaatacagtatgttttatattaccataatgatactcctagagaagccaggttcagctaatgaaactttcttaacagagagcctagtcattagtaaacctcataaatgtggcttttatttttaccttttgattaaagatgctttagtaaaatttaagacacctgtatcattacttatatagctgttgtaggtcttccctcctcattttactctcatttaatttcgttattttctcccgttagaagccccaactagaagctaaaggaagtcttgtattgaatttgggattatcttggaatttatattaaaaataaaacttgaaaatttctgacacaggaatagcagctagatttaatctcacaagccagtctccttgtaaattgtattggctgcttgaaacactgttgaaaagtttgcaaccgcttttcagtactgtgaaaaagagtacagtgattaattagtaatgttttccacaggccgtgggaggtggagtagcaatgtactatatttgtaatccccatttcactaattgtcttggaagatatactttttaagaccagacgtggtcaatagaaataaaatgtaagacacatatataattgtggcacttggctaccacattggaaagtacaggtttagattttgaaagcagttattttatccctaaacattccttgcttgttccttaacctaatcagcatagtgtttattagggaatctctgaattggtttctgcaaagacaggatagtttatagcagtatattcatgttttcttacctcgtgtttgaaacataaattataagtaggtattgtaaagactgctatgatcctagactagcattcttccttagtggcttttgttcctgccacataggtcagttttaacaaagcaacaaagcataatgttctttaacccactacttttgatttaggtgcttattctttatctctgcatcttaaaagtgtagactggaggcatccatctcagagatgatagggaagtctggggttagattctggcatattgtggttttgttttgagggggtgtgttttggcttggtttggttttggtttatgttcttgtttgtttgcttgcttaatcttcatgggtaactctgacatgagctactactgtgctttattccatggagatcttgaggctaggccatttatattaaaaatatatgtggggaagtaatgaaatacaaataagaaaagttggggctattggggctatgaattagaatgttgccaaagagaaaaagagattttgttctgaactttgtagtgaacacaaaaagagaattattctcactgttcaaaaggaaagagcaatccacttcttagggagaacaggccttttcacagaacttttacatgtgaagcttccttgtatacagggctttaaatcttgaaacaagttgctttagacacagtctgtattctctgcctcttttcttgatttctgagctaattagagtgcatccaagtatcagtgatggggagacattctgaagtatgcatcctttttcaaacatcatagagtgtacctacaggaacctaggtggcatagcctgcagctatacacctaggctgtagagtacagcctattgtgtctaattaggctataaacccgtgcagcattttactgtacttaatactgtaggcagttgtaacacagtggtaaatatttgtgtctaaacatagaaatctaaacaatctaaacagaaaaggtacaataaaaatatagcatacaagattaaaaatggtacgtaccatgtatagagcacttaccatgaatggagcttgcaggactggcagttgctgtaggtgagtcagtgagtgagtggcgagtgatattactgtacactactgtggactctatactacactgtgggtacactaaatttgttaaaaaaaaaaaaaaacaaatttttcttcaataataaattaacctcaacttactataattttttgactcttataataacatttagcttacaacacaaacacattgtacatctgcacagaagtatttctttttttgtttgtttttttgagacaaggtctgtgtcacccaggctggagtgcagtggcacatacagctcactacctcgaactcctgagctcaagccattgtccagcctcagcttcccaagtagctaggactacaggcacttgctaccatgcccacctaattttttatttttttgtagagatgatgtcttgttctcttgcccaggctggtctcaaattcctggcctcaagcagccctttcacctcagcctctcaaagtgctgggattatgagcatgaacaccatgtctggccttttcttttgtaacgtttttctgttttttaattttttaatttttttttaactttttaaacttttttgttaaaaactaagatgcaaacacacacattaggctaggcctacgcagggctaggatcatcaatatactttcatctacctccacatcctgtcccactgggaggtcttcaggggcagtaacacatacagagctgtcatgtcctatgataacaatgccttcttctggaatacccgctaaaggatctacctgaagctgttttataagttttaagtaaaaagagtacactctaaaataaccagaaaatgtatagtaaatacataaactagtaacataattctttttatcagtatcagatattatgtactgtatgtaactgtatgtactgaactgttaggactgtaggtgtagtaggtttgtttatatttaatactagcaccagcaaaaacacttgagtcatatgttctatgatattagaacagctatgatgtcactaggtgataggaatttttcagcttccttatgatcttatgggaccatcaatatatatgtggtctgttgttgactaaaatgtcatgcagcacatgactgtattgggtcatttgggatttgcattcttaagattttcagattccagatgaaattaacttctaacaatattttctctttaatccttatgtagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggtaagtcaggggactagagcaatgcaccctcattgtattcctatgccacagatcattttaaggaaacatttttaaaagaaaacatgttagaagatgcaatgaaaaaaacaaagtcctttcatttatctaatactaaaaattgctagacattgctttgaagtcataatctccacctctgaatttgaaatttttttcagtcttactcatgttttcttaaaaaattttttctaggccagagcaaatcttacccaggcctcaaatctttattctggacaagtacaacagcctggtcagacaaatttttataacactgcccagtcaccaagtgctctccagcaggtaaactatggcatggtaaatttcctcaattttctttattattatttttattgcttttgttattgtttgggaatttaaattgaaccaagatgcaagatggaggatggtttttgaactgttcactgagatgtcctgaagaattccactgggtccacgtagaaggggtttcaggctcatgacacccctcttctcaccaccatcaccccctacttcagtcattcctgtttttttatatcttccaggttttttgttggtttagggggttttgttttgtttttttctgtcacctaggccagagtgcagtggtgtgatcatggctcattgcagcccaacctcccaggctcaagtgatccttgcaccgcagcctcctgtgtagctgggactacaggctcacgccattatgcctggctaatttttcttcgtagtttttgtagagacagggttttgccatgttgccccaggctgatcttgaactactggtttcaagcgatctgcctgcctcggccttccaaagtgttgggattacaggcttgagccaccacacctggctgctttttgttttttgtttttttttaattaagggggaaaaaacaacttaggtttccgtgtaattatttattctattttaacaaaggattcaatgaatataaaaccttgaaaaccattgtccagaatatagttacattaagtgtgatacaggtggtttacccattagtgctagggagaagcctcccaaagaccatctggcaggttagctatacatacaacagtgtggcagactgtgatcgagcataaatgacaaacactttcttaagtgtatgaatgcaataataattttcagtgaaaagtatatggtacgtttaaaactatctctaataatttcattagcttattctttaaaagtggtggagggctggtgggggaacaagtcattagtcattttcttataactgttgttgtttgctattttagggagtgataattcatgaatatcttattgacattcagattaaatatagtgtttatgtgaaaactgagagattcttgttcttctcatagctcattttgaccagccttgaaagtattatgtaaaatgtctgtttggaaacttgtgaatactgcttatattgtgtcctcatttactttgtgattatttgacatgtcctgtggataaattcaaagatagtcctaattctttcagtttctattctcttcactacaagtagcattaactaaactatgttgtacctttaatagaagaatggagatacggttgagggttgagtgtctcttaccgaaatgcttgggaccagaaatgtctcggatttcagattggtttttttttgtgtgtttgcgtatacataatgaggtgtcttggggcgtggggcctgtctaaacatgaaattcctttgtttcatacatactttatacatataacctgaaggtaattttaagcaacattttaaataactttgtgcatgaaacagaagttctgacctcacttcgactgatccgtcgcaggaggtcaggtgttgatttttttttttttttttttttttttttttgagacggagtctccctcatccaggctggagtgcagtggcatgatcttggctcactgcaacctccacctcccaggttcaagtgattctcgtgcctcagcctcccaagtagctgagattacaggcacccaccaccatgcctggctaatttttgtattttattttatttatttatttatttatttttttagtagagacggagtttccccatgttggccaggctggtctcaaacccctgacctcaagtgatctgcctaccttggcctcccaaagtgctgggattataggcgtgagccaccgtgcctggacttggtgtcaaattctctacttgtggtgtcatatcagcctctcagaaagttttggagcattttggattttgattttcagattagagatactcaacttgtcatcactaagcaaaagaaatatgtgaaatatattagtagatggatgtgttctatgtattttattttattttattttattttattttattttattttgagacagagtctcgctctgtcgccaggctggagtgcagtggcaggatctcggctcactgcaacctccccctcctgggtccaagtgattctcatgcctcagcctcccaagtagctgagactacaggcacatgccaccacatacagctaattttcgtattttttttttttagtagagacagggtttcaccatgttggccaggatggtctcgatctcttgacctcgtgatctgcccgccttggccttccaaagtgctgggattacaggcatgagccactgcacctggccgatgtgttctgtttgaaatcttactcaaaagtatttgaagagttgtgtatagttgtatggatatgtctgtagtaaacagaaacaaattgcttcagtttctctttacttattttctaggttacagtacctttaccagcatcccagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaagtaagtaaagagacatttgcacaggttatttgagaatttaaggtagtgtgttcagatatatgcatctgtgttatctaaaaaactaaaatgcgtcagtttttaccaccctgcaaaaatctcaaaccccagtatatttacattttatctatttacttttaatgtgtttggccccatctagtttttacctaataacaaagaattcacaaatttattggaagaattggatttatagtgtctcttgggcttatttaattataagtctgtttggtcaggtaattccataatacttgaagcctaactataggagttttgtactaaggttctttgccctttcctagattacgtcttcacgtataggacatgtaaacacagcacttagcttgtggaattaaagaaatgttaagtttattttatgcttctcctcagatgtctgaaatggaactaaaagcctttggaagtggcattgatataaaaccaggcacacctccaatcgctggtagaagcaccacaccaacatctagtcccttccggtaaaatgggcatttaaatttgcttatgaaattccaatttggtcactatttgttaaatacttatcagtcctgtgtgacataatcccttttccaagcagaaaaggaattattaagacattctttttgatagttttgtctaaaatgttaagctcttaaattatttaaaatgtgtgtattgtactatattttaagtaaattcttttgttacagagcaaacctttttttcttttattttttttgagacagagtctcacactgttacccagactagagtgcagtgccatgattatagctcactgcaacctcaaacacctgggctcaagcaagcctcctgcctcagcctcctgagtagctgggactacatacacgtgccaccacacctggctaatttttaaaaaaatattgtccaagctggtctcgaaccagccaatctaactggtaactggtatcctttcttacctctgctcctccaatgtctctcttctaccagaatgttttggtaatcatcatagtaaatttttaccaactaccaagtatgatgaaaataccaagaacggtgtttgcaaaaatctaacagcattatttacttggtattactatactgactagtaatggcttctttccaagggctacttctacaagtccgaacagccagtccagcaaaatgaacagcattgtctaccagaagcagttccagtcagcccctgccactgtgagaatgacacaaccatttcctacacagtttgcaccccaggtgggcagacataattaagaaatgagtattatttacttaaaaatagttgctaatctgataaattattatcttgccttatgttaaccagttaagaagtacagtttttaataaaaaattgtttctgaatttaacaataaatttattttataaagatagtctgcgatttatagccagacatggtaattgtttagttctaaagcagacaagagaaatagttaaaagattccccacacagctctgataatgagtccttttccttttaactttttttaaggagttgacttttcagcgaagggtcccagtgcttgaagttttctaggtttaaagttgttttttgttgttgttaagatatttatgtgcaattgagataaaatttccaaaaagatgttttaatatatgtaaaaaatgttggcttctcttccccttgctgatcgtataaaaggactaagaactctcacaaactagaactggttcctgagaaattcacatttgttgaattagtattggttttatttatcttcagattacatttgttacaggtgtgtgccttttctgcaactaccttttgaaaagatagcctaattaaaagtctttctatccccccttcagaatttacaactgagatgctaggaccaactgaagtgccatagcatgctttgcctagtttttctgttaaactctccaagcatggcctgtttattccttgtccttgttaatggaatggcacaatctgtacacttcctttcactggtaggatgggcacagatttactctgggatgagccaacctggtctagttggcagttttttttttttttttttttttaacagttcaatgttgtatgttttgtttttttcactcagattctctctcagcctaacctggtccctccattggtaagagccccacatactaacaccttcccagcgcctgttcagaggccaccaatggcactggccagtcagatgcctcctccgctgaccacaggcctcatgagccatgctcgtttgccacatgtagccaggggtccttgtggatcactatctggagtcagaggtaatcaggcccaggctgcgttgaaggctgaacaagacatgaaggttagtacagtgttaacagccaacagatcaagaatctgtctctgaaccatgtcttaaaatgcctctggacccataactgtatatccaggcattcattgtcttagcagacttaaccaagctaactacttttattcattcccccttttttttcttttttttcccccattcccattcctttcatcttttttttctttttgtttctttttctttttctttttttttgcaactgtagtcaggaaatgaattaatgtcttaaactgtggccaaatgaattgttatcaaataaatatttgagggagatctgagtttagatgcacacttttttttgaaatagcaaagaagtaatatcaattattatagacttccccattttctttctttttttttttttttttaatatatattttcttcccccctttcccctgactctcctcctcccagcagcttaaaatgtaaatcatggttatatgaaaactctggaatgggtaagatgtgttactatcttagtacttttttccattatgagtcatcaaagtacagttttcttctcaaactgttttcatacccttattggcctaccacatgaggtggttgtattccacagtggattgtgcagttatagatgaagaactcagaaaagcactttgggatccttcatgatgaaaggcactgataaacatgaggtttgctaatgcagaaagagtgcctttaggagtctgtgtggggacagttttgtagcataaaccttacatgtctgccagtacagccagttgaatccgtttatttctatatttactttaggcttgactttcagggatcttagtaatttttgcctgttttgtcactacatatgtcatcagatcagactagaacaaagaaaagcttactgttttcaaacagggaaatgtgcatagtaatgctttactctgaattagaaacatgtttatgataatcctattagaaaatttgattgattgattaaagtgtctttttgggtcgacatccctagtgtttctgatcctgagtaatcaaatttaaagactacccagcagcaaaacttttattaaataattatctacttttattaaggctgtatgcctaggatttccatctgtttgttataattagaaataccagtgtgagtaaaaatcttaggaagttatttggccttggattccagttctactcctggctccttggctcttgattttcgcatattcccatgttggaaataacattagagcttaatagtagtaatggggtgggagagggtacaaacttcttgaaaattgcttcagatctttggatagtacaggttacctatagaacataaagcatttttttaatatgcaagaaggatggaaacttaagttttaattgtgaatgttacagtggtaaaatttacagatttgacgtaagtatatttttgggggcacatagtcaaaactaagaaattatttaccagctcagaatgtggtaggagctatcagaacttagtgatcaagtgaagtcgtagttactaatttctgatgctcttcccctgcagaagagagctgtgggaagaggactcagccacaagacatttggtcctaggtgttggtaatgccacaatataagtgcttccttttcattttattgtagaccacatattgataactagaagttttaagtgttacatgtatgtttttagatttgcaagcaggttccctaaataaaatttaatatgagagggcagaccttgaaaaggtggtgggaggtggtcctgtggtttttttttttttttttaaatcacatgaaatatttcaaaaataggaagaaatctattcattaaaagctcaaagatcaatgaggtacttttggctttggccaaaccagtgtggggaaaactgatttgtgattggtaaaagaatttgaaccaagattgatttgacaggctttggtaatgctgcagtattttcagttgttctttctcattttttaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcattttcagtcagaatttatatataaatatatgcacccatttttttgagtgcatataatttagacctaaaaatccttatgattaggtgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattatagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgattcttgg

SEQ ID NO: 8958 - DNA, 664 bp, Homo sapiens
  misc_feature (335)..(335): n equals a,t,g, or c
gtctcgtcgtaataatatgtggagttctgcagaacatactactatataaaaacagcgagtcagctaggcaccgtggctcacgcctgtaatcccagcactttgggaggctgaggcgggcacatcagttgaggccagcagttcaagacccacctggccaacatggtgaaaccacgtctctactaaaaatacaaaaattggttgggcgtggtggcgcacactcagctgctcatgtagctgaggcacaagaatcgcttgaacccgggaggtggaggttgcagtgagctgggatcaatcgtgccactgcactttagcctgtgtgacacagcgagactgtngtctaacacaaaacacaaacaaacaaaaacagcaagtcaccaaatattatgtatcatacatagaagtgtgtttaaaaaaaataccacccttttaaaattaaatgtcaatcctctaaatattttgctagattctagtaggtaggtttaaaattggagtagaattgctggttcaatgggtagattcattttcaattttagtagattatgtgaaattttaccactgacaaaatctgcgtatctataccccattggcggtatataaatttttttttcatgccttcacaagtactagttatgtttgtgtgtacctgtctactagaagttttcca

SEQ ID NO: 8959 - DNA, 986 bp, Homo sapiens
gaaacccacagaaaatactgggctttatggagcaatccatttgaagagattgctgaattctgaactactgagaaagcacagagaattacaagcatcaacattattttaaagtagaaaagccaatgtaggaaatataaaagctatgttaccgtgctccttaaaatcaggacaaagttagttccaaacatcatcctgtgtgttattcaaaaaatctgatgctctctgcagatctatgaaggagcaactggctcaatttctcaaggtcacttctagcttccggctcctgcttcttctaacttggatgggtttggggattgcccccctgaccctgtgctatactgcaataacctaaacaaggactcagcagtttcccttagttttcactgcagaccacttatcaaaggcatgtgtgtgcaggacaggcttcaccgaaggtttgaggagccagaggggtttacattgcaccttgagctggaaaagtaaaatattggcagtctccgtccttcaaaaacagcaggtattttgtaactcaggctcctgccttctccctgtagctcacccttttttcttttcctcatttctttgacccatccttcccaaaggcaaaaaaataaaagccagaaccactctttccattttattactcagaatagttcagctatctccaagctgaacccttcaacacagctgtggtcttcctctgaatattagcagaagtttcttattcaaaggcctcctcccagaagaagtcagtgggaagagatggccaggggaggaagtgggtttattttctgttgctattgatagtcattgtattactagaaatgaactgttgatgaatagaatatattcaggacaatttggtcaattccaatgcaagtacggaaactgagttgtcccaaattgatgtgacagtcaggctgtttcatcttttttgtttattttcaatgcctaataaacagagatcctaaaaaaaaaaaaaaaaa

SEQ ID NO: 8960 - DNA, 989 bp, Homo sapiens
gaaacccacagaaaatactgggctttatggagcaatccatttgaagagattgctgaattctgaactactgagaaagcacagagaattacaagcatcaacattattttaaagtagaaaagccaatgtaggaaatataaaagctatgttaccgtgctccttaaaatcaggacaaagttagttccaaacatcatcctgtgtgttattcaaaaaatctgatgctctctgcagatctatgaaggagcaactggctcaatttctcaaggtcacttctagcttccggctcctgcttcttctaacttggatgggtttggggattgcccccctgaccctgtgctatactgcaataacctaaacaaagactccgcagtttcccttagttttcactgcagaccacttatcaaaggcatgtgtgtgcaggacaggcttcaccgaaggtttgaggagccagaggggtttacattgcaccttgagctggaaaagtaaaatattggcagtctccgtccttcaaaaacagcaggtattttgtaactcaggctcctgccttctccctgtagctcacccttttttcttttcctcatttctttgacccatccttcccaaaggcaaaaaaataaaagccagaaccactctttccattttattactcagaatagttcagctatctccaagctgaacccttcaacacagctgtggtcttcctctgaatattagcagaagtttcttattcaaaggcctcctcccagaagaagtcagtgggaagagatggccaggggaggaagtgggtttattttctgttgctattgatagtcattgtattactagaaatgaactgttgatgaatagaatatattcaggacaatttggtcaattccaatgcaagtacggaaactgagttgtcccaaattgatgtgacagtcaggctgtttcatcttttttgtttattttcaatgcctaataaacagagatcctaaaaaaaaaaaaaaaaaagg

SEQ ID NO: 8961 - DNA, 418 bp, Homo sapiens
attagttacaaccaggcaattaaaaatctgtccccaaaaaatggcaaagcagataaatctctcagacagacatccataccatgtttgagtatttgtttttcttattctggaatagaaggtaatcgacaattattgggaggagaaagaaacctgtatttgtggaaaaagaatctcccttagtgtttgttttacaatcctgcagtacttcctatttctcttcgaaattgtcacctttaaaaagttgaggttgcctcatgtgctctcagtcattgaggatctagattgcagcttctccaggacttctgtttctcccacctctccagcctctcacttctggttcatctagaaaccagatgtgagatgtatgtgtgtaacaaagccaacatctctctctcacacacacacacacacacacaca

SEQ ID NO: 8962 - DNA, 209 bp, Homo sapiens
agaagaagcaaaagaaaaaacaccaaaattgtgccttcatctttcaaaggttcttaaacttctagttgcataagaatgtccccaaagtttttagttcaagaggtctgggatggaactcaggaattggaatagctatcaagtttcaccagatgattctaatgcaaggtgttcctggatcacattaaaaagtactgtagtcagacgggcgc

SEQ ID NO: 8963 - DNA, 420 bp, Homo sapiens
attagttacaaccaggcaattaaaaatctgtccccaaaaaatggcaaagcagataaatctctcagacagacatccataccatgtttgagtatttgtttttcttattctggaatagaaggtaatcgacaattattgggaggagaaagaaacctgtatttgtggaaaaagaatctcccttagtgtttgttttacaatcctgcagtacttcctatttctcttcgaaattgtcacctttaaaaagttgaggttgcctcatgtgctctcagtcattgaggatctagattgcagcttctccaggacttctgtttctcccacctctccagcctctcacttctggttcatctagaaaccagatgtgagatgtatgtgtgtaacaaagccaacatctctcacacacacacacacacacacacacacaca

SEQ ID NO: 8964 - DNA, 209 bp, Homo sapiens
agaagaagcaaaagaaaaaacaccaaaattgtgccttcatctttcaaaggttcttaaacttctagttgcataagaatgtccccaaagtttttagttcaagaggtctgggatggtactcaggaattggaatagctatcaagtttcaccagatgattctaatgcaaggtgttcctggatcacattaaaaagtactgtagtcagacgggcgc

SEQ ID NO: 8965 - DNA, 13001 bp, Homo sapiens
ggccgggcggtcgcagggactccggggcgaccgccgcgagtccgcagtagttcgggccatggaggcggagccgccgctctacccgatggcgggggctgcggggccgcagggcgacgaggacctgctcggggtcccggacgggcccgaggccccggtgagcggggacccggagtgcgaggcgcgggcgtcccctgtgggccagggtccccccggcgggggcggggcgggccggggggcggcgggcaccgggggacacgggttcggggcgcgatcgcgggtgcgagcggcgtgcgtggctcgcagctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggtaggtgccgctcggggacccggggccgccccgcccgctcccagcccggcccgggaaacagaaaccgcgggccgccgcctcccgcccgctctcacttcccctccgctgccctcgcagctgcagccacggccccccgcggcgggggtggggttggggggtcaagtagcgcagcgtccccgggtcccagccagagcctcggtgtgggtgggggacgggggtccgggctcccggacagacctgccaccgtcagaattggaggccggcggagcaaggcgggtgggggtctgggcttagctggccaagtggccgcgggctggcagaaggcgtggcgcagcccgggaaccccgctgtcctgaggggcgctgtcagcgggaatgccttcggtgattggagctccctgcgaggcctgcatgccgtcttctgctcggtggcgcccaaagctaggctgctccctgcacgccgctctctgtcctgtccccaggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggtgggcgcggctgctcctgtgggatgctgcggtactcccatttcggaggggtacagaggccggcgggccaggaggtgtccatctgccggggtgtttgtggggcgagggaacaagggagaggtttttttctacccggaagcctgagagtgaagggggtgaaactcggatttggggaaggaaacaggaactttgcctcagggcacatttggtttccagcaacagattcacacgggctgagctccctcccagcttgcctgggcctcacgtggcaccctcctcgtggcctccttggaggcctcccagagccactgtggccttcagggttggggctgtagagttaggggtttctgatcggtcagcaaagtccaggcacccatgcctggcccagtcgctgtgactggtgctgagggggtgtttctcacagacaggcatggctgggcaggtgccccagagctctcccccagatctgagccctggaggtatgtggttcagcctccccatcaccggtccacagtgccctccctgatgggacctggagaccagtggacaaattaggtgaatttgagctccctcatctttaaaacaaacaaacaaacaaaacaacaagagaaaactccatttaaacaaaaatttgaaaatttaaaacatctcccgttgcacaggcaggattagaataactgaaatcataaaaaagaaaccccatctaagccctccaggaaatcggctacccatgctgtcccaccagcatgcatggattacattcacatccttgtccccagagcacgtgtgtggacgtgcccgtgtgtgtgtgtgtgtgtgtgtgtgtgtgtgtgtgtatgcaagcgggctatgtttgcttttgcttgcttacttttttttttttgagacagatacttgctctgtcacctagactgcagtgcagtggtgtgatctcggctcactgcaacctctgcctcccaggctcaagcgattctcctacttcagcaccctgagtagctgggattacaggcgcctgccacccggttaatttttgtacttttagtagagatggggtttcactatgttgaccaggctggtcttaaactcctgacctcaagtgattctcctgccttggcctcccaaagtgctgggattacaggcatgagccacagtgcccagagcttgcttccttcttttcactgagcatatcttagcctactctacagccttcacagttacgactttgcaatggtagcatcttctgcagatacggtggcactgaacagtggcttggaattggacactgcagttccttctgtgcttacatctgtttccttgttttttttttttaaattatgtgtttatttattttattattattattatttgagacagagtctcactctgtcacccaggttagagtgcagtggcacgaacacagctcactgcctcctcaacccccacacactgggctcaagcaatcctcccacctcagcctcccgagtagctgggcctacaggcgcacgccatcacatctggctgatttttaaagtatttgtagcgatggggagttgctatgttgctcaggccagtctcaaattcacccgccccagccccacaaagtgttgggattacaggtgtgagccaccacatccagcactcccccaattttttaaacaattatttttcctaggatacattttcaacaatgtctttactaggtccaagccatacaaaaggctttatggcttttgaaacctatcacttctactaatagcagtgaactcttgtctcctgtctgcccgacactctattttatttatttatttttatttttactttttttttgaaatggagtctcactctatcaccaggctggagtgcaatggcacaatctcggctcactccaacctctgcctcccaggttcaagcgattttcctgcctcagcctcctgagtagctgggattacaggcgcccgccaccacgctcagctaattttttgtatttttagtaaagacggggtttcaccatgttggccaggctggtctcaaacttctgacctcaggtgatctgcccacctccacctcctaaagtgctgggattacaggcacgagccaccacgcccggccgtgctgggcactttataagcgcaatttcattcccaataatttgaggaagctgctccagtcttagacatgaagaaaccatggtgttaaacaacttgcccaggtcccacaggcagtaactggcagactgaaggcttgaaccccagtagagggactcaaatccacatgttcaccccctgccaaaactaccaggctgctttcccaaagggttatgccagtgtgtgtgaccactggctatatgtgccactttttttttgagcaatcttgctgttgcccaggctggagtgcggtgacgcgatctcagctcacggcaacctccacctcctgggttcaagcgattctcctgcctcagcctcccaagtagatgggattacaggtgtgcaccaccacacccggctaatttttgtatttttagtagaggtggggtttcaccatgttggccaggctggtctcaaacttctgacctcaggtgatctgcccacctccacctcctaaagtgctggaattacagatgtgagccactgtgcctggcctatatgtgccactttcaaaccacatcctcaccagcagtgaatgcacatttttactggcatttttacttaaggagcataaatacagaaaacttgaagataccagtagtggtttttggcctgatcagcctccatgggtggttgagccctcatcctgtcactcaccaagccccttctattgtcactgtgtgaccttttcccagacccagagaggtggaaacttcctgactgaccaccatggttcataaaagcaatggactggaggcaggggtgccgggactctggctctgctgctcccagcagtggggcctcttcctttctcttctcccagcctgagtcaagcccctgggccctacagacacagtgcatgagcttgggaggagaagggggaatgggagaatcagagagcccagaacacgcatgagggctggttacacccatgggtcactctccatcctcacagtggtgatgagaggcctgtggtttgggctccgtgcccatattacagctgggaaaactgaggcacagtagcttgcctgaggccactcagcaagtctgtgtatctgatattccatctcagtgccctcgactctctctacctcacaaagccctgtgagctgggacctgcggttgtggccccgtttggcttcaggccacagtggtccagcaggcctgtggtgccagcatctctcccactgtccgcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggtgagcctggtgggcagcagggcaggaggctggagacctggccaagcctccactttattgccaactttggctgggggaccacaggaagccccttccgccctctgggcctcagtttccccacaccggggctggtctgctcctagctctgggtgcaggacacacaggagtggcacaggtcgggctggggagagccttctctcctttgtggtccaggatggcgcagaagtaccatgagtactcccactacaaggagcaggatgggcaggggatgaagcagcggcctccgcggggctcccacgcgccctatctcctggtcttccaagccatcttctacagcttcttccatgtgagtgccacgtgggccattgttgggtggcaggggcagacccacgcattggagcccatccacagtctcaaccctctagtcccactttctttcttttattattgttatttttaagaggcctggtctcactatgttgcccagatggctttgaactcctgggctccagtgatcctcccaccttggcctcccaagtagctgggactacatgcgcacaccactgtatctgccccaccttcatttctttttctttctttcttttttttttggtgggggttgggggcagggtcttgcactgttgcccaggctggagtgcagtagtgcagtcacagctcactgcaaccttgaactgctgggctcaagtgatcctcctacctcagccttctgagtagctggcatcatatgcgtgtgctaccacacccagctaattttttattttttgtagagataggatcttactatgttgcccaggctgcccatcttcctttcttgagcccaccccagcttgctcatccatagagatagagatctcatctgcccttttccacaatgctggccaggaggaggtcttcctcattgggcggccctgtaaccacactactcccagaactgggaaggcccctgttcccccaaggctgtgcctggacccctccccagaccatgcctgtgtcccttgcctggctctgtgcctgagtctggtcccaactgcccttgtttctgcagctgagcttcgcctgcgcccagctgcccatgatttatttcctgaaccactacctgtatgacctgaaccacacgctgtacaatgtgcagagctgcggttagtccttgttgggggttggggaggagtccacaaagcctgcttacttccccagcagacactgggccctcactcacaggattcagggctggcagcccagtgccccacggctctggtgggcaagacacagggccctgtaggagtaagtagttaggacatctgacccagccaggagagtgggtgggcggggaagactgcctggagaaggcaccatctgggctgaggctgccagtgggatctttcttggggccaggcaaacagtcagagctcaatcagtgcagggggtgtgcatggaaatgtgaggtccactgagccttggggaaatagggtgggaagcaggggaaagatgcccctttcccggggaacacccagccccagtggtccaaacccagccccagtggtccaaacctccaaactgctctctgaaggaactctgcccttgctctcactctcccgccctccaccgctcctccgcggcctgcgtggctccaccctggtggctggattgactgtgtgccctactctctgctcacggtgccctcacccccacccttcccaggcaccaacagccacgggatcctcagcggcttcaacaagacggttctgcggacgctcccgcggagcggaaacctcattgtggtggagagcgtgctcatggcagtggcttcctggccatgctgctggtgcggcccgggatgggggcaggacagtcagtgaagcagagtgtggttctggggaccgagtctgcgagaaagggtctggatcggatggcatggcctgggtcgggttgtggcctcggggcaggccgtaggcctgggagcgcgatctgagttggggagctagggccgagtgctgcagagcgggcatgaggctcggaggcggggctgaggcctgtggtccgaggcaggcgtgggcatccagaggccaggggaaggagggaacaggcttggtccacagtttcgagctggagacaagatcttagaagactgactgagacctgtgagggggttggggacaggaccaagggtgagggctggaaggtgtggctcaaactggaagtgatactggacggcagaactaaggcgttggcatgctgcagcctggcgatggagctgggaggcaaggcccagtccgtggctgtgtcaggcggggcctagtgctgggacgcggggccgaagtctgtgggtgtgtccgaggggcggggactagcctggaaggcggggctgaggtctggcgcggggctgagaaggaaggttgaagtctatggatttgtctgaatgtgagttgtgaagtgtgtgtatgtgagagagaggggatggggccttgggctgggaggcaagaccaccgtctttcggagtgtggtggcgtggctttgtgctgagaggcggggccttgagctgggataaggcaagacctgggtctgtgggagtgtctcaggggcggggccctggtttgggaggcggggccgagctggggcaaggcccaggcacgtggtgcatctgaagggcggggctgaagcctggaggccaggcctgggcctggctggccgccccttcaagtaatgggttcgcaggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttggtaagtacagcctgcaaaggattgcccgacaaaagacaagatagccaggtaaatttgaattcaagtaaacaaagaataatttttaattacatatgtaagtgtgtacatgtatatcccaaatatccccctcctgctttctcttccctctcttacccccgtcccccctttaccttgggcaagttattttaacttctctgaatcgaaatgggatagcacccacagagtgtttagttccttgtggggtacagcccacggtgtctagggacattccaagcattttcacacctgccctcagaaccttcccctgagccttggagcgaggtcaggcagtccagggagggcagggtgtggcctaaggaacacctcttgtggggagtaagagccagcccttctccccacctggctcttactccccgtatcgcggggggcccctctccccaccctggctcttaggacccccatcgcaggggggtaaggcacccccccgcgatgcggggagtaagagccaacccctcttttccccccgactcttaggacccccatcgcaggggggtgaggcaccccccacgatgcggggagtaagagccagaccctcttcccccctggctcttaggacccccatcgcaggggggtgaggcacccccgcgatgcggggagggctgagactgtggtctgggctgttccagacttcaacactcaccccttgtccccccgcagggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcagtgagtatagctgtgggcactgggggggggggggcggggcagggggctttatggctatctgtgggtggttggcgagacatagacatcccagggacagatatggggtcccatggtcacatagggtcctgtggacatggcagaggcaggtggggcttcctgtggacactccgggggtggaagggaagtcttatggacacactggggacagatgggtagggtgtggacaccctggagacaggtatgggggttccatgccatggacattctgttaataccccagagcgggcacagggccccatcaacactggagggtcagtgtgaagtctcgtggctacatggggcaggtgtggggctctgtggacaccccttagggacagtgtgaaaaacacatcagggattctcccttttcataccaggggacagggcttaccctggcatagttttcatgacacttggagcagatgttttggtctctgcttcacggagcatgtggtaggagcaagtggcctgttgtacacccatggcatagatacagacatgggcctttgtatagagaggagcaggcctgcagccccaacccagtctgctcagtaccagagtccaggccccaggtctgggctgctggggaacagggccctgtttgcagaaggcagcgggtgggcccatgttcagctccaggatgctccctgaccacagatgggcacacgcagtgaaacacagctagcacacatgggcagtcctgccgggcatccatgtcagtgtctgttctgatgggccgaagctgtgaacagttttgaacgtcatccttgggggtgtggagtagccgaggtcatgcctgctgctggcagggcggaggctggctctgtgtctctgtctgtagcaggggctggagcctcatactgcaccacagtctcttggccgttttgcccaaggatagccaattctgggcagagtccagcctgggtatcttgaacccatgttgtgccctgtctggtcctggcatcccctctgcccagctccatatcccatctcctccggtgaaccccggggggtccttgtctcttcatagcagcactgtgggggtaaagtcaccctgcagggccccaaaacaggagtgttcatatcctgagtgcctggtgaaggtgttaatagtggcccctatgatttggcaggtgccatgcccactttctcactttagaacttcagaacacagcacacaataggcataagctcatctcaccattgggaaaagcagctctggggagttaagtacccaaatcacccacagagccaacattacagccctgagaacgagcgtgcatcttctgactcccaatccattactcttgttgcccaccctgggaggactcactggaaaggaatcccccctctccatgcttagcttcaggtttgatttgcagagttggcagctgcaaacagttcgatctctctagtcctggctgaggaggagaaacagcgcctgcaagcttggcactgcacacctgggttggggacaggacatgactaagcacagagctttcttcttttgaggccacgcatgtggtgcggagcgggaacacctgcatccacacagcccgaggcacctgctcctacttctgcttagcgtgtgagcagtgtggtgaccagggtctccaccagggggcaggccaggaccgcctcacagcactttctaggcgctctctggtccggggctgggacccatacagggcttagtaaagttcgtagatggtagctcggtagccccaggccccaggtgacacctctcccctgcctgccctgtactgcctgcctgcagcactcctgggaatcttgtacgaagacaaggagagacaggacttcatcttcaccatctaccactggtggcaggctgtggccatcttcaccgtgtacctgggctcgagcctgcacatgaaggtgagactgggcagggttgggggccccatgcccaatgacaggtacttccttagcccctgccctggcttcacagcttcctaaatgccaccccttcccaagccagtctctgggccaaggccccattcctgcagcccactgggtggcccccaactcagcaccccacttactggcccacctccagccagtctcagtttgcccatctctgaggggatttgtgggtgcatcacagccatcctgtgggctgtttggtaccttgttctccagatgttgggtctgtctctcttcatggcctgaaggggagcaggctcctcatgctctgctcacaaaaaatggtggctcggtctagcaagtcccagttgctaaacattttttaaaaatagaactaaaggccgggcgcggtggctcacgcctgtaatcccagcactttgggaggccgaggcgagtggattgcctgaggtagggagtttgagaccagcctgaccgacatggtgaaacctcgtctctactaaaaatacaaaaattagccgggcgtggtggcaggtgcctgtaatcacagctactcaggaggctgaggcaggagaatcacttgaactgggaggcggaggttgcagttagccgagacggggcgttggcactccatccagcctaagcaacaagagcgaaactccgtctcaaaataaaaataaaaatagaactaaaaatagcagggagtgggctggcagtagtggctcacgcctgtaatcccagcattttgagacgctgaggtgggggttctgagatctggagttcgagaccagcctgggtaacaggctgtgaaactctgtctctactaaaaacacaaaaattagctgggcatggtggcacgtccctgtgatcccagctactctggaggctgaggcacaagaatggcttgaacctgggagatggaggttgcagtgagccaagatcgcgccaccgcacttcagcctggaggacagagcgagactctgtcttccaaaaaaaaaaaaaaggaaaaaaaaaaaagaaaagcagtgagtgggctgggcatggtggctcacgcctgtaatcccaacactttgggaggctgaggcaggaggattgcttgaggccaggagttcaagaccagcctgggcaacataggagaccctgtctctacaaaaaatttaaaaaatagctgggcgtagtggcgtgtgcctgtagttccagctacttgggagactgaagtgggaggatggcttgagcctggaagattgaggctgaagtgagcgtgccactgcgctccagcagtgggtgggggaagggagggagggggcgcggtggggaaacggagcgaccgtgtctggaaaaaagaaaagagcaggaagtatgcatacagatatgtgtgtatgtactgggctatggtgtgaaatcattcctgactgcgggttatagtcaaaaccccatgaaaagcatcactacagcccacgggtgtgtcagggacacagtgttgtgagccctgggaaggcagggcctgtggccagcactttatcaacactggcgcatgcaccctatgaggcaaagggatttgcattgtccccttacagtgtgggacactgaggtcgccaggggcgtggcgactgtaagggacagtgctggatgtgagcctcgcctgcaggaggcggtccaggaagcatgggtggaggggctggagaagttgagggccgcgtggcccgggaggctcccggaggagggaagggcctatctcagcgaggggcataggcggggaaggtgcggggcgaggcggccgcgggtccctggcatccctctccttacgcccaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcctga

SEQ ID NO: 8966 - DNA, 728 bp, Homo sapiens
catccatgccagggaagtggtgtgaagggaatcacgtgggctgcccagcacgctcctgtgtcagtgcaatgcggggcaacaatattccaagaggttgtttcagggagttccagttgagagcaatatttattctcttctgcttgcttttctgcaaggaacatcgattattttcataatgagaactgaaagtaaaggcttattatagagaaaagcattggcaaacagtgagcacggggggatctggccaccccttcctggggatgtgactgtgcactgttgcaacctggatgggttggtggaggtgctggccctgctcagatctctgtcccgcaggtcaccctggtgtgtttatctgggccaccctatcagcctcttagatagtctccaggctccccaagagcagctccataaaccacctaaaaaaaaaaatcctttctggagagaggaggtgtatcagtcagggtttagtgcctccagggctgttttttgttttttttgttttttgtttgtttgtttgtttgagaggtctcactctgtcacccacgctggaatgcagtggcacaatctcagctcactgcagcctcatcctcctgggctcaagcaattctcccacctcagcctcctgagtagctggggctacaggtgtccaccatcacaccaggctagtttttgtattttttgtagagatgggttgggggggggggtttgtctcactttgttgaggctgg

SEQ ID NO: 8967 - DNA, 13001 bp, Homo sapiens; identical to SEQ ID NO: 8965

SEQ ID NO: 8968 - DNA, 728 bp, Homo sapiens; identical to SEQ ID NO: 8966

SEQ ID NO: 8969 - DNA, 13001 bp, Homo sapiens; identical to SEQ ID NO: 8965

SEQ ID NO: 8970 - DNA, 728 bp, Homo sapiens; identical to SEQ ID NO: 8966

SEQ ID NO: 8971 - DNA, 2235 bp, Homo sapiens
ggccaggcatggtggctcatgcctgtaatcccagcactttcagaggctgaagcgggtggatcacctgaggtcaggagttcaagaccagtcaggccaacatggtgaaaccccttttctactaaaaatacaaaaaattagctgggcatggtgatgggcacctgtaatcccagctgtttgggaggctgaggcaggagaatcgcttaatcccgggagctggaggttgcagtgagctgagatcatgccattgcactccagcctgggcaacaagagcgaaactctgtctaaaaaaaaaaaaaaaaaaactttttggggagatatgctttcatttctcttgggtaaatacctatcagtgaacttgctgggtggtatgtatggtaagtgtatgtttttattttataagagactatttttggtggcttttaacatatactttttttgctttaatgctacagttcctagtaatgttgactaagtgtggattttcttttttaaaatcctgtttgggatttattgtatttggattctgtgagttgttttctcataagatttggaaaaactctgcgttctcttcttcagttactgcgttttgtttttgccctccctcttttgcaattctaattgaacgtagacctttttactccctttcatgtcttttaacctcttttttctgttttccttttctttgcctctctgtgctgccttcagattatttcattagaactatctgtcagtttcctaattctctttttggctttgtctcatctgtcattagaaatatctactaggggccaggtgcggtggctcaagcctgtaatcccagcactttgggaggccaagaggggggatcacaaagtcaggagatcgagaccatggccaatatgatgaaaccccgtctctactaaaaatacaaaaagtagctgggtgtggtggtgcgtgcctgtaatcctagctactcgggaagctaaggcagagagaattgcttgaaccagggagttggagcttgcagtgagctgagattgcgccactgcactccagcctggagacagagcgagactccctctcaaaaaaaaaaaaaaaaaaaaagaaaccttacaaaatgcatttaatcagtctttcttgttttctatattttatttctttgaacatattaaatatggtcatttcttagtctgagattctggtaggtctttttcaatatctaatgtttcttttggttctttttccttctaccttgttgaattgtatgtttaggtttcttttcttctttataagtttgtatgtggaaattatgtggaaactccaggagctgttgcttttgagagtcaccattatagattgaatcctcaagggcttttggaccaccaaaatgacatgaattcaggctgcgaatccatgtgatttgatggccggtttttaataccagtttgtgagtggtgctacttttcaccatcttagagctaaggtttaaaatttaagacagttggcttttctttttacgtgttttttttttttcttttgtggtgggagtgtttctaggacctatatactgaagatgtagtactggagtttcatctttttgagagggaaatcaccttaatgccagttcaaggtttttctcctgtccttcatcgcctttgagatgggaaaatctgtacccaaggtcacctggtttagcaaatgttttcaaagtgaaaggtagcttcagtctttagcttatcacatagggatcccttcttcatttgatactttgcctttatccttgctttcttatccacttaatgacaaacttaaaatattttaatatatgtaacaattgtaaatatttaatatatgtaaaagttgtaaatagttctgtggggtggatacttagcctaccatgtttcctacaaaatgtgttttttaatgcaaacttactacccctttaacccttttaaggtagatctacctatttcctccttattgcttccactgtcttcttggcttagctgtagtacaggggatcctgtgaatcatctttgaatccttgctttgtatacagtggacattcaaggaataaatcacaatggaagattcttaatttggactccataatgtatataaggaaattaacccagattaaaagatcaattgcaaatccagaaaaatattttcaaaaaatgggttaactggtggattcatgtatgtatgtgtatacaaattttttaacatgaaaatttataccgtaaaaaaagaaaa

SEQ ID NO: 8972 - DNA, 307 bp, Homo sapiens
cttacccacatttttaccactttaaaatttttcattaccttttgtgtctcagaccttctgttgggatcacgtcgtttagtggcgtgtacttgcatgtgcacttgtgcacatgctgtcttgctctccctccccgaaagtgtctttattttgtaaacattcttaaaattagtctctttctctggttacttttaaaaaatcaactttattgagttaaaatttgcatacagtaagtttcacttaagttcagtgagttttgacacatttatacacctatgtgactaccacccattgagacagaaatatttct

SEQ ID NO: 8973 - DNA, 6958 bp, Homo sapiens
agatgctagcttggccaagtctgttatgttcacctgaaaaagtcttagcagagaattttgcattcccacccaaaagccctctcagccactcaaatgcctatcttctccagtctacaagttacatgttcccacccagcattacagttcttgaacatgttatttctccacttactggtttaagttggttttagtcactggataagtattataatagagctacttagctgtggttttaatacccttctgttaacaatttgcaggcaaattaatggccttttctaacatagttcaacccaccaaagacctcgacaccatcgttaccttgaaaccgattatggatcatgcccacaaggatccaagctactggctgcatcgaggtgaggggtgaagggtctgtgctagatcaaaaggcacggggtggcgatgtggcagagaagttgcttgtggggagaccttgcttttaacaggcttctggaaaagctagggaaaagtggttgcccgctttccccctttccctccccttcaagcaccgcttgagatttgggctttattattaagagctgctataaaaacagcttgcttaaatgttaagagaagcccaggggtacttcaaaagcattccttcggatgcttcactccagaaagagggagttgaggcaagtcctcattactaataaaaatcaggtgaggctgacacttctcttgaccttaggataatagcgctttgttgtctctcctgccacaggaaggctccatggttgtcctactttaagccttcggtgcctttagtgaggggtacctgaaaaatcttaaaaaaaggcttagcgcccacctcacccctccacccccacgccaacacagtttgctcacatgccagttactccagcataaagctgaaatctattcaatactattgtcccataactgatctgactttgtatgtaaatacagaaaaagcttgttcacctgttttcctcattttgtccactggtgaattcaactggaagctccttctatagtctgaagaataccatctgaaagaactagtggttcccaatccccacatttaaaatggaatgtttggtttatttaaagtaaataggctattttttcttactgggtctggcttctctggcccttcgcatacgtgtgtctgctgagtgttcctgcatgtaagaattaagaccaagggaggggagagagaaacccacacataaacaatgcactaaagatcactgaactgtttaaacatttccacttgccagtttaatttcttgaagactgttgcttgtttggaatgtttcttgtcactgattttaaggttgcatctggaaaagactaaaggcttcagtcccctcccaccaccagaaatgaacaaaaagcattttacctaaaaatacaccagcaaaatgtactcagcttcaatcacaaatacgactgcttaaaactgcagaaatttcctcaacactcagcctttatcactcagctggattttttccttcaacaatcactactccaagcattggggaacacaacttttaatcatactccagtcgtttcacaatgcattctaatagcagcgggatcagaacagtactgcatttacttgccaacagaacagacagacctgaagtcaagacaactgcattctctgtgaagtctgtaaaaaaaaaaaagctacaacaagtaagccccaccccctcctcccatccctccaaattccaggaaaaaaattttgagtatgctgataaactcactgcaaggtctcatacactcactagaacagaaggaagagccaagcactcatatgcaattcaaaatcctgaatggcttcatgaaggatgaaatgcctctgcaaaggaaaattctttaaaaccccacaggcaccccctcccttccctatataaggtcaatagtgtaaaacattgcctaccactctaagattgtaagcatttaaagttaacatgcaaactttggaaatgtgaaaaagtattactctaatcactgtcaatttatagacccctgactttctggaaataaaatgtgtaattaccttttactctgatcataatctcccacctgtctaagaggttatttattccttatttagagggcctctattgccatgtgcctggaattattatatgctcatcactttatgaagaataaaattgtctttcctgccttaaagttacattcgttcttccgctcaaatcctgatctggtccattaaagagtgttcgcagacaaagtttctgaaagattagagaagaatcccccccaagatagccccaacactgaactacagacaaacactattttatttaaataaggagacagctttctaaaagtatacattctctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtgccatggttgatatttaagaactccacagctcttaaaaataagcacttatccctaacatgcaatactgcagatgcaagttaaacttatctgttaacagctgcctgctgttttctgctcccagatgaaatgaagcaactcttctgataacgaagagatacctgtctgaggcaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgtttggcagttaaacaatggaaaagtatttctcctacactaaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacaggccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagatttgctgaaattgtctcaatttggctatcaaattcatttggttttcctcaaattcgtgtaaaaaaaaaaaacccacaaacttgccatctactatttctccaggacttggcagtctgccctcaaaagcttcagacaagattcatgagtataagcctgaaaagagaacctacacacccggaaatcggcctacgtccccatataaatccctttacacctcagtacgaaactcccccattatattagaaaataaataaaaggttaccataagtaagttccagaaaaacaacatattgccgacctcacggatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaagatcgccttcaaattattttaatcacctacaacttttaaactaaactttaagctgtttaagtcaccttcattttaatctaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttcaaagagaaaaaaacttatctgcggtttcctcaagctccgcctgccccctcagcagaagcccctgcgctggctgcctcaatgcctaccgcacagctcgggcgaggcg

SEQ ID NO: 8974 - DNA, 7514 bp, Homo sapiens
caagcccacagaacacccatcttttttccccaatcaagatttttttattcacaaaagaaccacaacaatttagagcttctccatttttattacacaaaattgttaagttttcagcagtagggcttctcaaaacaccagctgcaggctattacctgaaaaagacaaggcagttatattaggttctcgtgtaatatgaatatacaatcaagtcaagctcctgacaaattatacatcaaggatgtatatagttcaaagatattgtgctgttacctcccacctccccaaaactccaagaactagcacctgcagagaaaaggagaaatacagaaagagtcctgaagacagattagtagtcaaagcaaagacgccgcagggatttgaaccccgtcctgggaaccaggagtgccaaccaccagcatcttttgctttttttttttttaagctagaaaaaggccaaaaagcaaaacctgagaaaacaatacgtgttgttttctcaggaaaagaaaaaccttcatgaccctactgaagagcattggagatcagcttccgctaagatgctagcttggccaagtctgttatgttcacctgaaaaagtcttagcagagaatttttgcattcccacccaaaagccctctcagccactcaaatgcctatcttctccagtctacaagttacatgttcccacccagcattacagttcttgaacatgttatttctccacttactggtttaagttggttttagtcactggataagtattataatagagctacttagctgtggttttaatacccttctgttaacaatttgcaggcaaattaatggccttttctaacatagttcaacccaccaaagacctcgacaccatcgttaccttgaaaccgattatggatcatgcccacaaggatccaagctactggctgcatcgaggtgaggggtgaagggtctgtgctagatcaaaaggcacggggtggcgatgtggcagagaagttgcttgtggggagaccttgcttttaacaggcttctggaaaagctagggaaaagtggttgcccgctttccccctttccctccccttcaagcaccgcttgagatttgggctttattattaagagctgctataaaaacagcttgcttaaatgttaagagaagcccaggggtacttcaagcattccttcggatgcttcactccagaaagagggagttgaggcaagtcctcattactaataaaaatcaggtgaggctgacacttctcttgaccttaggataatagcgctttgttgtctctcctgccacaggaaggctccatggttgtcctactttaagccttcggtgcctttagtgaggggtacctgaaaaatcttaaaaaaaggcttagcgcccacctcacccctccacccccacgccaacacagtttgctcacatgccagttactccagcataaagctgaaatctattcaatactattgtcccataactgatctgactttgtatgtaaatacagaaaaagcttgttcacctgttttcctcattttgtccactggtgaattcaactggaagctccttctatagtctgaagaataccatctgaaagaactagtggttcccaatccccacatttaaaatggaatgtttggtttatttaaagtaaataggctattttttcttactgggtctggcttctctggcccttcgcatacgtgtgtctgctgagtgttcctgcatgtaagaattaagaccaagggaggggagagagaaacccacacataaacaatgcactaaagatcactgaactgtttaaacatttccacttgccagtttaatttcttgaagactgttgcttgtttggaatgtttcttgtcactgattttaaggttgcatctggaaaagactaaaggcttcagtcccctcccaccaccagaaatgaacaaaaagcattttacctaaaaatacaccagcaaaatgtactcagcttcaatcacaaatacgactgcttaaaactgcagaaatttcctcaacactcagcctttatcactcagctggattttttccttcaacaatcactactccaagcattggggaacacaacttttaatcatactccagtcgtttcacaatgcattctaatagcagcgggatcagaacagtactgcatttacttgccaacagaacagacagacctgaagtcaagacaactgcattctctgtgaagtctgtaaaaaaaaaaaaaagctacaacaagtaagccccaccccctcctcccatccctccaaattccaggaaaaaaattttgagtatgctgataaactcactgcaaggtctcatacactcactagaacagaaggaagagccaagcactcatatgcaattcaaaatcctgaatggcttcatgaaggatgaaatgcctctgcaaaggaaaattctttaaaaccccacaggcaccccctcccttccctatataaggtcaatagtgtaaaacattgcctaccactctaagattgtaagcatttaaagttaacatgcaaactttggaaatgtgaaaaagtattactctaatcactgtcaatttatagacccctgactttctggaaataaaatgtgtaattaccttttactctgatcataatctcccacctgtctaagaggttatttattccttatttagagggcctctattgccatgtgcctggaattattatatgctcatcactttatgaagaataaaatttgtctttcctgccttaaagttacattcgttcttccgctcaaatcctgatctggtccattaaagagtgttcgcagacaaagtttctgaaagattagagaagaatcccccccaagattgccccaacactgaactacagacaaacactattttatttaaataaggagacagctttctaaaagtatacattctctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtgccatggttgatatttaagaactccacagctcttaaaaataagcacttatccctaacatgcaatactgcagatgcaagttaaacttatctgttaacagctgcctgctgttttctgctcccagatgaaatgaagcaactcttctgataacgaagagatacctgtctgaggcaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacacgccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagatttgctgaaattgtctcaatttggctatcaaattcatttggttttcctcaaattcgtgtaaaaaaaaaaaacccacaaacttgccatctactatttctccaggacttggcagtctgccctcaaaagcttcagacaagattcatgagtataagcctgaaaaagagaaacctacaacacccggaaatcggcctacgtccccatataaatccctttacacctcagtacgaaactcccccattatattagaaaataaataaaaggttaccataagtaagttccagaaaaacaacatatgccgacctcacggatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaagatcgccttcaaattattttaatcacctacaacttttaaactaaactttaagctgtttaagtcaccttcattttaatctaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttcaaagagaaaaaaacttatctgcggtttcctcaagctccgcctgccccctcagcagaagcccctgcgctggctgcctcaatgcctaccgcacagctcgggcgaggcg

SEQ ID NO: 8975 - DNA, 1728 bp, Homo sapiens
tccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaagatcgccttcaaattattttaatcacctacaacttttaaactaaactttaagctgtttaagtcaccttcattttaatctaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttcaaagagaaaaaaacttatctgcggtttcctcaagctccgcctgccccctcagcagaagcccctgcgctggctgcctcaatgcctaccgcacagctcgggcgaggcg

SEQ ID NO: 8976 - DNA, 396 bp, Homo sapiens
ctgagccccgggggccgttggctgccagtggcccactctgatctgcggccccccagttgccgccagccccccacggcccgcacggaaatttttctaccgtttttcagcttccaggctctcctgaaagtgctcacaaggcaaatcgccatggaaagcgagttcaagtggccttttaaagtagaccaactaagcgaatggctttgtctccgaagacacagagaccttgggcagccagtcagggacacacccagaagtgtttacactgctctgggtctgcttttttaggggtttttgttttgcagattctgtgttatgcctggttaggtatgagcttcagaccttctgaaccggagcaggaagaaaaataaaagctttcctccaaaccccaagaccaaa

SEQ ID NO: 8977 - DNA, 396 bp, Homo sapiens; identical to SEQ ID NO: 8976

SEQ ID NO: 8978 - DNA, 7010 bp, Homo sapiens
  misc_feature (5395)..(5395): n equals a,t,g, or c
gataacctgggactgaccgttccctggggatccgacgggccccagaggacccacgcctgagccccgtgcgactcgtggcctttgggctagaagccatggacgccttcacccgcttcaccaaccagacccagggccgggaccgactcttcaggtgagtcaggtgccagcggcctccgcccctttctcgccctaactcggctcccgtgcctattcccctgcacccgggaaaaaggaggtgatagcctagtagatggaagcaggaaggacgttgccagctcctacggagggagtttagtatccgagcccctccttaccctaaattcaacgtgagtgggcccaacgcacccgcgtcccgtcctagccccgtgcacgaaagccccagtgcctggcaccctagccgcctcgagaccgccgacgacgggacaccggctgacagatcctcctcccctcctaactttgctctccgggcacagaaagattggttctctccactcaacattcttccgagggatctcctttaaagagaaactttggattagtatttgtggctagggaagcaaaccacttggtgtgacttcaaatatctctcttttttttttcttttgagacggagtctcgctctgtcgcccaggcagtggcgcggtctcggcccactgcaacctctgcctcccgggttcaagcgattctcctgcctcagcctcctgagtagctgggattacaggcgtgcactaccacgcccggctactttttgtatttttagtagagacgggggtttcgccatgttggccaggctggtctcgaactcctgacctcaggtgatctgtccacctcggcttcccaaagtgctgggattacaggtgcgagccaccgcgcccggtctcaaatacctcttgaaatgtttgaggagagacagaagttctcttccattattacccaggctgtatcattgagatactgcatgtggaatagttttgtaaattgtaaaacaaaatatagcggggatgagaccacaccaactggattggggggaaatacagtggggagaagctcagaaagaactaactgcacctctaaggttcatgctgtgctactgaaaatattaaacagagattgtgtctctttttcttttggttccataagaaacgaaaagaactgagagattgtatctttaatacgaatacagtactagttcatgatgttttagagatttggttgattcttgcttaatgaaaaaatatttacagttgcagttttatttaacagctctgcattctcttctgggtgtgcaagtgctgatacaaacagatcaattagaatggccccaataatgaggcttttggaagccatctttatgacagctattgttcccagtgttttgcaactatgaacttatataaccctcatcacaaccctatgaggtagatactctaaatattttacccacttcagatggagaaactgaagcagaaagaggttaataggtactacaatggcagaactgagggattcacatccacgcaaatgactccagtgcccacttaactaccaagctatactggctttctcattagtttgataggttttttaaatggttactttatatacaagcttcattaaatagaaatttcattaaatagaaacctgtaattccagtgtacctagaatgtaccctgcagggtttatcaaggaagttggttaaaaaaataatcatttaggccgggtgcagtggcttacacctgtaatcccagcactttgggaggctgaggtgggcggatcacaaagtcaggagatcgagaccatcctggctaacatggtgaaaccctgtctctactaaaaatacaaaaattagctgggcgttgtggtgggcgcctgcagtcccagctactcaggaggctgaggcaggagaatggcatgagcccaggaggcaaagcttgcagtgagccaagatcacgccactgcactccagcctgggcaacagagcgagactccttctaaaaaaaaaataaaaacattaaaaataataatcatcatcatttaggccgggttcagtgactcacacctgtagtcccagcactttgggaggctgaggtgggcagatcatgaggtcaggagttcgggaccagcctggccaacatggtgaaaccccatctctactaaatatgcaaaaattagctgggcgtgatggcacatgcctgtaatcccagctactcaggaggctgaggcaggagaatcgcttgaatccgggaggcggagtttgcagagagccaagaacgcaccactaccctccagcctgggcaacagagcgagactctgtctcgaaaaataataataataataatttaagatatgtttattccaaaagatctgagatctctagcattcatttcccaacctccttgatgatctgtataacctttatgaccacactggcattcataaaataataccttgctttctgtgccaataatgctcatgcaaacacggtgaacattcctaaaacctgtcagactgtaagaagtgtggcaagcaccaaccccacaaagtgacatagtacaagaagagcaaggattctctgtatgcccagggaaagcagcattatgacaggaagcagagtggctgtggtgggcagactaagccgattttccagaaaaagtctaaaactaccaagaagtttgtgctaaagcttgagtgtgttgagcccagtgaagatctaagagaatcctggctattaaaagatgccagcattttgaactgggaggagataagaagagaaagggccaagtgatccagttctaagtatcatcttttgttttattatgaagacaataaaatcgagtttatgttcacttcaaaaataaataaataaaagtaatgtcttactgttggcctgatccttattattagaccaaagctcagaaaggcagaatcattgacatgaccagtcctgtaaccaggaaggacacttaaaaaagagaaagcgattgtttatgattccagtcttctctttttatttcattcctagtaacaagttcactattttagaaaatgaaaatgtaccgcatttttattgagaataatatttatagcataaagggattcaaatgcacttacaagacagtaggaaccaggcacctactttattagtagattgccaaatggatttggatgtgtgactatgtgatgtaaaatttctcctacatttatattagtaagtcattgttatttgtaagcatgacaataatcactttattaaatatatagtattattaagcaggattctgcctgtattttatgtaaaatacgaataagttttgaaagacaactatgaaaacatatttatactaatttatgtactgatgtgtatttggtcctttcgtttataaaaaattaaacaatctttaaactgtggacttttcatttggttctggtttgagtttgtgtcctgtcacatagatggtaggttaagtacatggtagaaaagttcattttagaaatctgaaaatcaggccaggcacagtagcttatgcctgcaatcccagcactttgggaggttgagtagggcagatcacgaggtcaggagatcgagaccagccatgaccaaaatggcacaaccccgtgtctattaaaaatacaaaaattagctgggcgtggtggcacacacctgtaatcccagctactcgggaggctgagacaggagaatcgcttgaaccagggaggcagaggttgcagtggagccaagatcacaccacagcactccagcctggcgaaagagcgagactcgatcaaaaacaaacaaaaaaaaaacaaagaaagaaatctacactggggaagagaaggaatatggatctttgtagacttaacatgagggagattttgtacagtttctcactttgactatatccatttctctgtgccagcaaaaggccttttggaggcacattggctgcattattgcagaatttgttttcattacctttgtgttaaatttccatgacatgttctaccctttggctctcctgtagaatgactgttgcagaattttgcttttgtaagagttgctacatgagaaatggtcttggaaatgttgtctggaggcatgtgtttctctttcccttacttcctgaattaagttttatttggtttgtaaatcattcttctcaatttttttttttccatttcagagccactcagtacacatgcatgttgcttagatatttgttagagcccaaagctggcaaagagaaggtggtaatgaagctcaagaaactggagtccagtgtgagcactggtcgtaaatgtaagtaccctgtttcttgagggacagtgactcctggtttagaatcctcagcctcagaccctgtaattcacggagtaatttctaggtcattaatttctagtcaatcaagtttattggtgaaattgaccagtaaggctgtcctcatggcacaacaggtttgaatgtgttgctgcagaccattcataaacaccctcttatgttcacatctggtgctacaccttatctttctgctgaatcataaccagtgagacagacaacgtgttagttcacctttagttcttagaatcatagtatgttttagcagtctctgacatgagcttctgctcctgtgagcccctttattctaaacaagagtggaatagttatatcctagaccacctgcctttttcctttattgaggagtgctagaggatatataggtggatacatttttgtagaccatgtttgaggtaggtttcatgccaaaggtaaaaagtgaaatcaatattttgtgtttattaaatttactttaataatatgtcatactgggaaatccagtacttttcatagcaattgcctttctgagtctttgttgtttgatgaaaaccagatgttgctatagtaggttagcagaggcattagaatggaatgtagagcatcacatattgatcagttggttttgagcacctatgttatataggtacattcctgagccttatgggagaagtaaggtgctttaaataatgatatataagatttagtgccaaacttgttggctgaggtagaggaaaagaaaggtgttttagaggaggtggaacttgaggtgaggctagagagaaggaagaagagagtttcgaagggcagttttctctaataaaggctcagaactgagtaaaccattgtatgggaggatcattgtcaaactacaaaactagtttgacagatttaaattgtcaagcagagggatgggaagggtagggcgagcttttctggatggcactgaaggccaagattagaaattctatttagattatttagaatgttggagctgaaaggtcctttagaggtcactagtctgtaagtccagaaggggcttatccagggtcattcagccagttnagtgcaagggccagaactggaacccagaatctatatactaaaatagtcattacatatactattttactattttatgttatttttgataacataatacaaaacattcttttttttttttttttttttttttgagatggagtctcactctgttgcccaggctggagtgcagtggcatgatcttggctcactgcaacctccgcttcccaggttcaagcaattctcccacttcagtctccctagtagctgggactacaggcatgcgccaatatgcctggctaatgtttgtttttattttttattttttttagtagagacggggtttcaccacgttggccaggctggtctcaaactcctaacctcaggtgatccgtgcaccttggcctcccaaagtgctgggattacaggcgtaagccaccgcgcccagccccttctgagattataagttttctgagagtagctacttctgagcacctcctgagtctaaggtatgatccttcaaggaaaagtacttcttttgtatcctccgtgacatttagtactataactctttctcagaaggtgttcagtaagtacctattgattgatgcatccctgattaattgaattacgtgctcacataaggacgtgccattgcaatggttgatttaattcaactaggagctctgtgacaatattattaattgttctatccattaaattctaccatttctactttatcttcttgacaataggtagccaaaaggggtttggaccagagaaatggcaaaatgataatagtgttttttaaaaagacagtcttttgtctggaaaataaataaaatgcaaggcatcagactctccaagagagtattgcatctggagttcatgttatcatagtaccttccttctaaagaagtgtagctggtaaataatcaaatgtaacagtccacactcatgattgaccttgcctggagtatgccgtcagtcaacattaaggtgttcattacaatggaggaggtaaatttaaagagtcactgtattttttgccttccaagatcactttaggtgtccttaatgtactgtaaaatctttctctttttctgaacaaaggctgagcctttaatgaccatcagttgttaaaaagaccagtgctaagctgggcacactggctcgtgcctataatcccagctactcgggaggctgaggtgggaggattgcttgagcccaggagactgaggctgctgtgagctgtgatggtgccgctgcactccagccggtgtgacagagcaagaccctgtctcaacaaaaaacaacaaaaagctggctcctcaccctgatacagggattctatcttcctgttgtgtactaatgaaataactgttcactattgtgggttctacttgcagggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagc

SEQ ID NO: 8979 - DNA, 195 bp, Homo sapiens; identical to SEQ ID NO: 7691

SEQ ID NO: 8980 - DNA, 142 bp, Homo sapiens; identical to SEQ ID NO: 7400

SEQ ID NO: 8981 - DNA, 387 bp, Homo sapiens
ctcttttaggatttcctcaggtaacaatcttctttcaatgttcaataatccaagcagaacattttctcacttcatccgcctcccatgctaggttcacactgtgaaattggcttatctctgacctaaccacttccttcaccagacatagagctggtgtagctcaagggaaagaggcacggcgctgggaaatgattaggccccaccgtcccaagcaagagctcaggggagttctgaggctggagagaccattcgggatatcaccccgggttcctgagaacctgagatctgcggggaggcgtcaggcatccggaaacgcccgagtctggggagacggaccccctcagactttcctctaggagactctacaggtaaaggggagtcctggga

SEQ ID NO: 8982 - DNA, 370 bp, Homo sapiens
cttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggt

SEQ ID NO: 8983 - DNA, 4704 bp, Homo sapiens; identical to SEQ ID NO: 7404

SEQ ID NO: 8984 - DNA, 1677 bp, Homo sapiens
cctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctcaaaaaaaaaaaaaaaaaagaacttggaaatgcccccatatatactagttgtgatgaagcattatttttagttaagtcatataagaatgactgtgtatgaccaaaggcaaatatatgtggaagaaactcaccaggaattcttttgtgggtttttattcaatacatgtcagtaggggagttataccccctttttaataagtttgtgttaacctacagtctaaccaaggcatcttatcccagtgaatgccaccaccattcaccctggttcccaaactggtaacatagaaataatcttgacatatcttcctatcactttgtcatcaagtcctgtcatttttaccttgtaaacatctcttaaatgtgtctacttctcaccacaccctaatctaagctaccatcagcaccttttgcctgcatgactgcagttgtctcctaactgttcttcctgcagcgactctggccctccctgtattcactcgactgcaagcagaattctcctttttgttcgaagttcaattttaatcaagacaacccacctacctgcacttgcacccctagcttaaaatgctcgaatggctttttattgtccttaatgatgaaaaggaaatattttatgtgaccaaatatatttgacctatgaggtcagatatattagggccactatctaaagcatagttccaagcattaaaatagttactgtctcagattaaaacagtggctggcacatcacctcaatagaggttacctattcttgttgccacttagcctcatatgtaccatgttttacttaataccttcattgtcctttaagtattcggaatgagaattacagtgcttcattcagcataagacttttgttcatgctgtttctttggcctgaaatatctatcccttcccaattgcctaattaattcctatttgtctttcagatcttagctagttcatcacttcctcagggaaacattccctaatttctgtcacagagtaagacccgttgttatacgtctcacctgaccatgtacctctacttagcatttaacacgtgtaattttgtatgtattggtttgattaatgtcagaaccactagattgtaaactccatgaggaccggaattttgtttctgtcattgtcattgttcaactttgtattttttatgcctcatacagtgcctggcacatagtaggtgctcaattaactttattgaaagaataaaatgaatggatgaggtatcaag

SEQ ID NO: 8985 - DNA, 703 bp, Homo sapiens
gtgatcttagctcaccgcaacctccgcctcgtgggttcaaatgattctcctgtctcagcctcctgagtaactggggttacaagcgcccaccactacgcccagctaatttttggtatttttagtagacacagggtttcaccatgttggccaggctggtcttcaactcctaaccccaggtgatccgcccacctcggcctcccaaagtgctgggattacaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaac

SEQ ID NO: 8986 - DNA, 224 bp, Homo sapiens
aaatactgaaatttagcatatatgttgtcaacagtattgttacaatcttagcaggtttgagaatttgaaaccttttagggaagcatattaaaaaatacaaactcaatgtttttcctgctatatatatagtattataaattatgcacaataaatttttggtcccagaaaaaacacatcacttaataaaaatagtaatctgggtttttttttaattctgaaatcat

SEQ ID NO: 8987 - DNA, 4133 bp, Homo sapiens
ttcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaaggtaggatattctgtcctgctctctagaaattaacttaatgcatttaactataatgtaaacagtatttaactttaatagtcatttcctttttttttttctttttttgagatggagtttcacttgttgctcaggctggagtgcaatggggtgatcttggttcactgcaacctccacctccccggttcaagcgattctcctgccacagcctcccaagtagctgggattacaggcatgcgccaccatgcccagctaattttttttttttgagacggagtctcgctctgtaacccaggccggactgcagcggcacaatctctgctcactgcaagctccgcctcccgggttcatgccattctcctgcctcatcctcccaagtagctgagactacaggcgcccgccaccacgcccggctaatttttgtatttttagtagagacggggtttcaccgtgttagccaggatggtcacgatctcctgaccttgtgatccgcccgcctcggtctcccaaagtgctgggattacaggcgtgagccactgtgccccgcctgtatttttagtagagacagggtttcaccatgttgatcaggctggtatcaaactcctgacttcaagtgactcacccacctcagcctcccaaagtgctggcattacaggcatgagccaccacgcccagcctcgtagtcatttctaaaagatctgtattcctattttttttgttatgtgaatatttaatcacttctttatgagctctgtccccatgtgacctttctcattacatgtatttattactgctttcagaaaatatctaatgcaagcatgttcttttcttcctttcatcatattaaggacataataatatttcctttcagtccctttaggttgtacttaggtttttttcttttgttttataacaccaagtttttagattatttcattaagctattatgtcactacttacaaaccatggaaatattgctgtaaatatataaaagtaggtcattatattgaaataatttacggttcaatgtggaaaatattagaaaaacaaaatatttgattttgattttaaatattatctatttttgttttgcctctttgtttgccctcagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttggggtaaagtcctgattttgtactagttatttaagggaggattttctgagaaaatgttttgaatatagtaggcatatgtataatctaatgttaaaataagttatataatgggtaataatttttagatttcttagataagttacacattcccaggatgaggtgaactttcaaatatcaattttaaggctattgattatattgggaaaaatgaacaatgacttggatgttaatgtgtgtgttttccttttttaagggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgaggctgatcattcagtgaataaacagttgttttgtgtttaagaaatgcaaagacaaataggattcaggtaactcatgatagcaagagagtttggtgaatatgggcagttgaggaaatctaatatagctgcaatatagcagagggctgtgggcagtggtaccaaaggcaggtttggggctaaaattatgaaaggtattgtatattctactgggtagcagataataaatgaaagattttaagttgcaaagtgactgtcatatgattttatacattaaagtttactagtggtgtgaaaagaccatctaaaggttatttattaaaggtactataaataactctgagaattcacataaatggttgtatattttagtttagtgtatgtttaatatctttgatttatttttcttccacaaccgtgaatctataaatgctcaggtaatgattttttttttaaaggttgtaaatcagattctgtttgagggataagaggtaggaaaataatagaaaaaaggtttttatcatttttttccattagttcctagtatattgcaaattgaagagtacctccttagttttttaaaagttttattttaataaaatatatgctagatatatattttgtaaaatgcatgctctatattcataggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtatatatcaatttgtcttctttttttttaatt

SEQ ID NO: 8988 - DNA, 473 bp, Homo sapiens
aaataaaattatagcactttactaaaaaagggatgtaataatgttatttaacgaagtattttatatatgacttgccactattctatacataaaattttttttcttaattctttcctgtgttaactagggttattttctatttaaggtaatcctgctggagaacagatgctatccaatatttattacaacacatgagttgtgttgtttcacaatactgaatttcttaggtgaggtattttatttaaaaaggagggggaaaactcctatattttcttgacttcaaacctgtggggccaggggatatagattgaaatgctccgtatttagtcttggggatcaggcttgtttagtacaataccatggttttagaagtctgtactaggaacatttttaaaatacattttttatatttcagatgtaatgcagtgcacttttatttgaacaataaaaaaacccataactttttgagacca

SEQ ID NO: 8989 - DNA, 2607 bp, Homo sapiens
tctgtgtctaagtgttgcagaaaaacccaacaggcacagacacacctacctggaaacaatgcttccctagaagtgggaggaaaccagaactggaggtgccctccttctgggggtaggagtcagctaatagacatccaaggtgtgcaggagtgctttcactctgcgcaggaaagatcagagagaagtccagagccttgcctgcttgtaagtacccacttgtggctggggggaatttcctaactgttcacggttgcagagcttgattaaataaagctctcattagtttaagaaatgacccaagaaaggagagagaagtcgggctgtttttaaatgtaatatgattttccatttacttatttatctttaaaatgaggtaaagagcaaaacatctggagtaagttgcctcaggaaggtcttattggctgttggctttgcaggtgatcctggtggagaaggtggagtatggtgagctgcttgctaaggacagccaggcaacgctgtgtttgtgaagatgtgctccaccttctcctctgcgcatcccagctcctcctgctgaaacagctgagcttgctttttggatttcttagactcctggcctctgagagacacctctaaggacaaactgaccttgcattgggaactttattatccagatcctcataggctttgtctactctggattgcttgttgcaacagttcttaggaagcaagagtgtctcctgcaccagcatctgcctgtgtttgcttttacctactttgagcaagacccagtgaggccctagctctgttggtcctgaaaagcctgaaccctgaggctgtttctcctgcctccaaaatgcaattataggaaataagaagcacagaaacagtggaaacaaccaggaggagaaacaagaaaacctaaaattttcaatattcaaaaatacctgtcgtggtggttgatgcagaaaacactgagttcatcaaagagctttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagtataa

SEQ ID NO: 8990 - DNA, 326 bp, Homo sapiens
atctcctgacctcaagtgatccacctgcctcggcctcccaaagtgctgggactacaggcaagatccatggctcctggcctgcaatgccatttctatctttccttttataacacaaagttttttcttcttctattgataccttctttagagtcttcctatctcctcttggtaggttttccttctcaatctaaatatgtatacacacacatatatatattatgcatattatatataatgtatgtatatatataatatatatgtgtgtatacatttaatatttcagcctttcccactcttcctccttcaaatcgcttgctttacttgag

SEQ ID NO: 8991 - DNA, 3514 bp, Homo sapiens
gtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttcctttttttttttttttttttgggccaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgccccggaggcatctcagtactccggctttggcggaggaatagagacttttgcctggcaatgctcctactgccattttttttgtcccactgctggctcactggggtttggcgtcatccccacttgggaggc

SEQ ID NO: 8992 - DNA, 4933 bp, Homo sapiens
gtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataagggcatttgtttcaatgaaaaagttagtgttaaaggaagtgagtcagggagggcggagtttgttgtaaggcaatcacctgtcaaaacagaaattgggtgggaaaggagtctttatcttggggagcaaaagctgacttttaaacttgacccctgctgtttttaaacagcttttccttttggtctctgacagtcaatccaggttttatgttatttcaaaagggttatttttgtcctccttttttaatagcttcaggaaagttaaaggtatcatcttaggtctaacactctagtctttgagagttacggttctttcgtagaacaatttccatgttgttaactgttgtagacttaattgaatcacattttgggaccagatgtatttggggatagaattctttaaatgtatgggacttcatgcttcctgattatgtaatatttcctgtggttgggaatcctagaatgcctgatctattttatctgttcaggtagttttgttattgtaccctcttttgggtcatattctagtatttctcacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatacta

SEQ ID NO: 8993 - DNA, 4934 bp, Homo sapiens
gtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataagggcatttgtttcaatgaaaaagttagtgttaaaggaagtgagtcagggagggcggagtttgttgtaaggcaatcacctgtcaaaacagaaattgggtgggaaaggagtctttatcttggggagcaaaagctgacttttaaacttgacccctgctgtttttaaacagcttttccttttggtctctgacagtcaatccaggttttatgttatttcaaaagggttatttttgtcctccttttttaatagcttcaggaaagttaaaggtatcatcttaggtctaacactctagtctttgagagttacggttctttcgtagaacaatttccatgttgttaactgttgtagacttaattgaatcacattttgggaccagatgtatttggggatagaattctttaaatgtatgggacttcatgcttcctgattatgtaatatttcctgtggttgggaatcctagaatgcctgatctattttatctgttcaggtagttttgttattgtaccctcttttgggtcatattctagtatatacacacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatacta

SEQ ID NO: 8994 - DNA, 5690 bp, Homo sapiens
agtgattctcctgcctcagcttcttgagtagctgggactacaggcatccgccaccacacccggctaattttttgtatttttagtagagacggggtttcaccatgttggcgaggatggtcttgatctcttgacctcgtgatccacccgcctcggcctccccaagtgctgagattacaggcgtgagtcactgcgcccggcaggaaaattctttttaatgcaacagtgcaatttctctcattcttgctgtatttggttttctggaacagaaggttgtgaggagacaaatcttaaacagactattaatttatatgttgagatcattatttaatattaaattgttaaacaacagctttgagacatagctattttgattctcctatttgtttttgcctgtaaaaaagtttatagaaaacttgattttaagaggttatttaatttaaaatttaagactcttctacacactttcctttgaagaataattaaaataggaaaaaagaatcagagtacaagttatataggcagacactgaaattagaaaactaggcagatctttgtctctcctagttatcatgctaggattttaggacactgttaaaatataaagacataaaatctcattacaagtaattgttcttacaaaatggcttcccaaagtataatatgaatagtatatagtagtgtgaaataatgtgtaatatgttgtctacccaaagtgtaatctgaatagtatgaatagtatgaaatgataatgatggtttggttgatgtacaaaatatttttagagacattactgaagattattaaaaaaggaccattgataaagtaaaatatcctaagcctactagtggatatgtggtcatgttataatatattcagttacttaacacatattgagaacacagtaaggcacagttattctcacacttatacctccactttatttatttttttgagatggagtctcactctgtcacccaggctggagtgcagtggcacaatctctgctcactgcaacctctgcctcccaggttcgagtgattctcctgcctcagcccccccaagtagctgggaccacaagcatgtgccaccacacccagccaatttttgtatttttagtagagatggggttttgccgttttggccaggctggactcaaactcctgacctcgtgatctgcccgcctcggcctcccaaagtgctgggattacaggtgtgagccattgcgcctggcctacttcagctttcaaataatgatatatggtcactatcaacttacctttgatgctttcaaaattagaatttgttcagaattttttgtttacctataggtgacactaactaaaactatgaacattatgaaacaaacctccacttacctagtacaaatgaaaagaacaagcgggtagttattttcttgaggacgtaaaacagtcacattctaagaaatctaattctttcaaggcccaacctgtgtatcttggaaggaggtcactctgtgagcaaaggttaggaatgggacccctgtttatgcaaagtatcaaagttaagctgtctcttcctgatagcttttatgttagattgtttttcaaaaatgcctttccacataatctgaaaatgtcttcttcagacaaaagctttatccattggatgctttggtatctttcctcaagatagcactgatttagtgttttcaccccaataaatgaagactttgatcactccagcatctttgtgactcagggagacagactgacacattagtatacatttttctgtggatcgaaaacatgttatgtcttatcaaggattgatatgatcttctaacacaaatagagtttggaaaaggataaaataccattcacacattcattaataaatatttgagggctttctacggtactaagtgctgtgaaggacaaaggtggctctaaagataaactagacatggaccttgcccttgagtatttcacatggtgcttaaggtgaccagacttagttatggaaatgtaataattatagtacaggatagataatgtttcacgctgtgagtgggggtaaaaatattcctaacaaattttacatgaagaaatgatcaaccctaaaaatttgtacactgggccgggcacagtggctcatgcctctaatcccagtactttgggaggctgatgtgggcagatcacctgagatcaggagttcgagaccagcctggccaacatgatgaaaccctgtctctactaaaaatacaaaaattagttaggcgtggtggcacgcccctgtaatcccagttactcaggaggctgaggctggagaatcacttgaacctgggaggcagaggttgcagtgagctgagatcgtgccattgcactccagcctgggcgacagagcaagacactgtctcaaaaaaaaaaaaaaattgtacatttttcattgcttcatttgaaatcccaaaggtccaatataaatctttctgtggaagaccatctgaatgtaataaaaattgctattgaagaatccctaataaaaagtattcaaattgtggcatctttctggtactgaggaggccataaaggttcagtaatacccatccacatggctacctagagtcttaggaatggtcatttctcaagggactgtcaggctgtctgggtctgagcagtaatttgatgcacgtatggggtgctgcagctttagaaacatgtttccgtctattatctgttaattattatccctctggacagcctggcacatggtaagggcagctaagacagcagggtcctaattctgctcagctctctctgctgtaaaatgattgatttggtgaccggattttctccaagtttccttgtgtaggtaggtgcgtagggcaaattatattatcaccattttatagaaagggaaactaaggttaggagagcttaagtgactcgcctaaggcctctgataataactgatatccaatacttgagattagacttcaggcccagaaggacaaagcatctgcttctatatcacactcagaaccacacctaatatttgtggttaagagtaccaatagaggcccacatagcattaacctaagtatttaagtcataaatcaagataacaaactgttaaacaaaatatgatctgtcctcccaccttgacaaatacctcctacacggagctggatggccagttgtgaactatgaattcctggacttctctaagggccaggctggaaggtgtcatggaggataaagctgatcgcgaatgatccctcttcctgcattacgaggggcccaaagcacctgggagtgcacaccttagcccacaggtccaggtactgtccacaccccaaagaagagctatttcttggacacaggagtgagttcagagtcccgaccagatcctgaaagtgaacttggcaccatttgggcagagcagtccagagttctgactacatggagcgtatgtagtctagaagagggtcaggctccagctgggccatcagcctgaccggaagaggggcactgccagaggagagccagagggtggctgtgggcggaggtccctcttgggtttaagagccagtctgatcacacagcctctaaaatcaccctaagaaagaataacataccggaacattcatgtgacgggtaagtatggtccagtggttatgagactaggctctgcaggcaaatccctgggttggaatcttaggttggccactttctagttgtggcatcgcaggcaaattattgatcatctcacagcctcagtttcctcatctttaaaatgggtaaataatcattattatgaggagtggcagtatatgtaaaacgcttggtggacattacacattgggtggatgttgacagggttctctccagcttaggcgagtttgcctctgagaggtttttctggagaattatataagcttcataacatccaagcactctgacagtcaaggtgaaagtctcctctctctactaaattggggtgaggcgcgggtgtgggcaccacccaccccacccaaggcatcaggggcagcccacgtcccgcccggttctgtgcccaaggacttcacgctgcagacgtgcacggaagctgctttggccaggggtttggaggttaactagcaaacgcagcgtgagtcacggcggcactaggaactgaaaccgtgttagccatgcccaggtttaccctccgatgcggacggtgaaaccagggagcagtgacatcaggacggggagccagcgctgacgcagctccaccgcctccctccccatcccgcacccgccgccgccgagctcagcctgcagacaggtcttgacatccctcctcagcgaggagcgagggagtcggaacaagtcggggcatctcccttgcacctcccgggagcgccagcccagccaagtctagcgattgcccggcccgccagcgaagacgcttcctctgaagcaagcttggacactcccctacccctccgggtgaaacgaattccaagtggcccatttcggctcctcgccccctcccactccctgcaaaaaaacttggcaactctgcggtttcttgcggaccaaaacctgtaattagccctttgtgctccctttaaggggcagtcgtgactggaaaccgaggagtcagaccctctcgaaaacaccaacaaagaactatatttagttctgagctctcagcctaaatgcctcttattttttcacttttacttcaaaacgccagggttggggaagtgggaggcagagggtgggggagcaacggagaaagaacagctgtgcctccgcctctccgctcaatctctataaataaccaatcgcgagcggaggctactttttagccaatgaagcgccccaaactgataaagccttggcggcagccaatgaacaacacttaggggtgtcagactcgcgccccgagaccaatgagtgcagagtctgggagaggtaatttgagctagagtgtgggtgtgtggtgcaaaagcttcctacttccaagcccaaaaacctgctctgcgactgagcatgccctgaactaactgcgggcgccctgagacttctggattgggatgtaatccggtctccgggttttgaccgcactcgagcggggaggtgggtacgacccgcgggaccctgccccgagagagctgcaggtaccagaagctacccctttcctagtcggaacagtatctcagacttggagtacctcctgttttctttgtgcaaggctgcagtgcacagagtcggtcagagaagacagagtagcgtttctgtggcgaacggtttagaaaaatctatggggcaggtttgctccgccggctgctcgtgcattccacggcacccacaggacttcgggtttccggcccccagacccacgcccgcccggggctgagtgaatggcgtccttgggcctttgataacgggagttggcaagaccacagcctactccatccctgaggcggcccgccgcgcccacgtgcttctcgcagagccgccgcccttgtccaccactcccacagctgtaaaataaagcggcctgcatgcttcctacagcgctttcctcgctcccatatacgcacacacaccccatcttccagccagttcctaactcgcgccactccccaaatcggactcaaatccggagccccgcccactgccccgccccctcccggccccgcggaaaaccaggagcggccg

SEQ ID NO: 8995 - DNA, 751 bp, Homo sapiens
atcttcatatcatggtaagcacatgcgtatgtctgtgactcagtttcttagccagacttccaggtgttagttaattccttctcatttagttctactgtaatccattctgggaaaatgcataccacaaaactgtgtatcttgcagcttctttcgttatgcatcttaattccctcagaaggtcccagaactttatgttaaagatctgggtttttaaagacaatttgggggccttctaaagaaacaatagtagatctaattacaagtagtggattgcttacttcaaatttctcttttacaatttagaaagtttagtaccagtttatagactgagggagtagtagctactatttagatgctgagaataatattatcatgcttgggtggggaagaaaggcccttactcaaatctccattttcatttttaatgcttcctggacttcagttattttcttgcttttgcctcaagaataataaatatttttggttaaaattttttttgttcaaccctgttgttgttactgttattttcatagcacagtagtctacagctctctatagtagcttaatagctatttgctgaatgaatggaacatggagtgttacatctgaaactattctattagaaggtgaaaagtgttgattgaagaatggtaggattttatcttccctacccatgatagatttattaagattgtctttggagctatgtcttccattccaactatacagaaataaacttttttaaagttta

SEQ ID NO: 8996 - DNA, 5690 bp, Homo sapiens
agtgattctcctgcctcagcttcttgagtagctgggactacaggcatccgccaccacacccggctaattttttgtatttttagtagagacggggtttcaccatgttggcgaggatggtcttgatctcttgacctcgtgatccacccgcctcggcctccccaagtgctgagattacaggcgtgagtcactgcgcccggcaggaaaattctttttaatgcaacagtgcaatttctctcattcttgctgtatttggttttctggaacagaaggttgtgaggagacaaatcttaaacagactattaatttatatgttgagatcattatttaatattaaattgttaaacaacagctttgagacatagctattttgattctcctatttgtttttgcctgtaaaaaagtttatagaaaacttgattttaagaggttatttaatttaaaatttaagactcttctacacactttcctttgaagaataattaaaataggaaaaaagaatcagagtacaagttatataggcagacactgaaattagaaaactaggcagatctttgtctctcctagttatcatgctaggattttaggacactgttaaaatataaagacataaaatctcattacaagtaattgttcttacaaaatggcttcccaaagtataatatgaatagtatatagtagtgtgaaataatgtgtaatatgttgtctacccaaagtgtaatctgaatagtatgaatagtatgaaatgataatgatggtttggttgatgtacaaaatatttttagagacattactgaagattattaaaaaaggaccattgataaagtaaaatatcctaagcctactagtggatatgtggtcatgttataatatattcagttacttaacacatattgagaacacagtaaggcacagttattctcacacttatacctccactttatttatttttttgagatggagtctcactctgtcacccaggctggagtgcagtggcacaatctctgctcactgcaacctctgcctcccaggttcgagtgattctcctgcctcagcccccccaagtagctgggaccacaagcatgtgccaccacacccagccaatttttgtatttttagtagagatggggttttgccgttttggccaggctggactcaaactcctgacctcgtgatctgcccgcctcggcctcccaaagtgctgggattacaggtgtgagccattgcgcctggcctacttcagctttcaaataatgatatatggtcactatcaacttacctttgatgctttcaaaattagaatttgttcagaattttttgtttacctataggtgacactaactaaaactatgaacattatgaaacaaacctccacttacctagtacaaatgaaaagaacaagcgggtagttattttcttgaggacgtaaaacagtcacattctaagaaatctaattctttcaagacccaacctgtgtatcttggaaggaggtcactctgtgagcaaaggttaggaatgggacccctgtttatgcaaagtatcaaagttaagctgtctcttcctgatagcttttatgttagattgtttttcaaaaatgcctttccacataatctgaaaatgtcttcttcagacaaaagctttatccattggatgctttggtatctttcctcaagatagcactgatttagtgttttcaccccaataaatgaagactttgatcactccagcatctttgtgactcagggagacagactgacacattagtatacatttttctgtggatcgaaaacatgttatgtcttatcaaggattgatatgatcttctaacacaaatagagtttggaaaaggataaaataccattcacacattcattaataaatatttgagggctttctacggtactaagtgctgtgaaggacaaaggtggctctaaagataaactagacatggaccttgcccttgagtatttcacatggtgcttaaggtgaccagacttagttatggaaatgtaataattatagtacaggatagataatgtttcacgctgtgagtgggggtaaaaatattcctaacaaattttacatgaagaaatgatcaaccctaaaaatttgtacactgggccgggcacagtggctcatgcctctaatcccagtactttgggaggctgatgtgggcagatcacctgagatcaggagttcgagaccagcctggccaacatgatgaaaccctgtctctactaaaaatacaaaaattagttaggcgtggtggcacgcccctgtaatcccagttactcaggaggctgaggctggagaatcacttgaacctgggaggcagaggttgcagtgagctgagatcgtgccattgcactccagcctgggcgacagagcaagacactgtctcaaaaaaaaaaaaaaattgtacatttttcattgcttcatttgaaatcccaaaggtccaatataaatctttctgtggaagaccatctgaatgtaataaaaattgctattgaagaatccctaataaaaagtattcaaattgtggcatctttctggtactgaggaggccataaaggttcagtaatacccatccacatggctacctagagtcttaggaatggtcatttctcaagggactgtcaggctgtctgggtctgagcagtaatttgatgcacgtatggggtgctgcagctttagaaacatgtttccgtctattatctgttaattattatccctctggacagcctggcacatggtaagggcagctaagacagcagggtcctaattctgctcagctctctctgctgtaaaatgattgatttggtgaccggattttctccaagtttccttgtgtaggtaggtgcgtagggcaaattatattatcaccattttatagaaagggaaactaaggttaggagagcttaagtgactcgcctaaggcctctgataataactgatatccaatacttgagattagacttcaggcccagaaggacaaagcatctgcttctatatcacactcagaaccacacctaatatttgtggttaagagtaccaatagaggcccacatagcattaacctaagtatttaagtcataaatcaagataacaaactgttaaacaaaatatgatctgtcctcccaccttgacaaatacctcctacacggagctggatggccagttgtgaactatgaattcctggacttctctaagggccaggctggaaggtgtcatggaggataaagctgatcgcgaatgatccctcttcctgcattacgaggggcccaaagcacctgggagtgcacaccttagcccacaggtccaggtactgtccacaccccaaagaagagctatttcttggacacaggagtgagttcagagtcccgaccagatcctgaaagtgaacttggcaccatttgggcagagcagtccagagttctgactacatggagcgtatgtagtctagaagagggtcaggctccagctgggccatcagcctgaccggaagaggggcactgccagaggagagccagagggtggctgtgggcggaggtccctcttgggtttaagagccagtctgatcacacagcctctaaaatcaccctaagaaagaataacataccggaacattcatgtgacgggtaagtatggtccagtggttatgagactaggctctgcaggcaaatccctgggttggaatcttaggttggccactttctagttgtggcatcgcaggcaaattattgatcatctcacagcctcagtttcctcatctttaaaatgggtaaataatcattattatgaggagtggcagtatatgtaaaacgcttggtggacattacacattgggtggatgttgacagggttctctccagcttaggcgagtttgcctctgagaggtttttctggagaattatataagcttcataacatccaagcactctgacagtcaaggtgaaagtctcctctctctactaaattggggtgaggcgcgggtgtgggcaccacccaccccacccaaggcatcaggggcagcccacgtcccgcccggttctgtgcccaaggacttcacgctgcagacgtgcacggaagctgctttggccaggggtttggaggttaactagcaaacgcagcgtgagtcacggcggcactaggaactgaaaccgtgttagccatgcccaggtttaccctccgatgcggacggtgaaaccagggagcagtgacatcaggacggggagccagcgctgacgcagctccaccgcctccctccccatcccgcacccgccgccgccgagctcagcctgcagacaggtcttgacatccctcctcagcgaggagcgagggagtcggaacaagtcggggcatctcccttgcacctcccgggagcgccagcccagccaagtctagcgattgcccggcccgccagcgaagacgcttcctctgaagcaagcttggacactcccctacccctccgggtgaaacgaattccaagtggcccatttcggctcctcgccccctcccactccctgcaaaaaaacttggcaactctgcggtttcttgcggaccaaaacctgtaattagccctttgtgctccctttaaggggcagtcgtgactggaaaccgaggagtcagaccctctcgaaaacaccaacaaagaactatatttagttctgagctctcagcctaaatgcctcttattttttcacttttacttcaaaacgccagggttggggaagtgggaggcagagggtgggggagcaacggagaaagaacagctgtgcctccgcctctccgctcaatctctataaataaccaatcgcgagcggaggctactttttagccaatgaagcgccccaaactgataaagccttggcggcagccaatgaacaacacttaggggtgtcagactcgcgccccgagaccaatgagtgcagagtctgggagaggtaatttgagctagagtgtgggtgtgtggtgcaaaagcttcctacttccaagcccaaaaacctgctctgcgactgagcatgccctgaactaactgcgggcgccctgagacttctggattgggatgtaatccggtctccgggttttgaccgcactcgagcggggaggtgggtacgacccgcgggaccctgccccgagagagctgcaggtaccagaagctacccctttcctagtcggaacagtatctcagacttggagtacctcctgttttctttgtgcaaggctgcagtgcacagagtcggtcagagaagacagagtagcgtttctgtggcgaacggtttagaaaaatctatggggcaggtttgctccgccggctgctcgtgcattccacggcacccacaggacttcgggtttccggcccccagacccacgcccgcccggggctgagtgaatggcgtccttgggcctttgataacgggagttggcaagaccacagcctactccatccctgaggcggcccgccgcgcccacgtgcttctcgcagagccgccgcccttgtccaccactcccacagctgtaaaataaagcggcctgcatgcttcctacagcgctttcctcgctcccatatacgcacacacaccccatcttccagccagttcctaactcgcgccactccccaaatcggactcaaatccggagccccgcccactgccccgccccctcccggccccgcggaaaaccaggagcggccg

SEQ ID NO: 8997 - DNA, 5690 bp, Homo sapiens; identical to SEQ ID NO: 8994

SEQ ID NO: 8998 - DNA, 751 bp, Homo sapiens; identical to SEQ ID NO: 8995

SEQ ID NO: 8999 - DNA, 1265 bp, Homo sapiens
ggtcaaggacaagtgccttctaaggcatggataagggctttcttcttatgaaagtctagactgtcttactgtgaagatggccagggaggatagcaagcaatggcattcttgaacagtctaaggcaggtttctcagtgtggtcctgagaacagaagcatctgcatcacctgggaatgtattagaaatgcaagttcccagccccatcccagacctactgaatcagaaactctgggggcgagggctgaaacctgctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtttagtgaattttccatcaggttggccattactttctttctctaaagtctcaggatgtctggaagcaaggaaagacaaaagacttgaagcaccgggtgcatgctgtgtgtcacaagtgaggtggagagttggctgtggaaggtacagcaattcctctggaattaaatgaccgaccaacacagtaccaagaggatgaagagaagatgttttgcgttgctacgtgaatcagtggatgactcatatttcacttgcatatgaaatataaggcagttaacatcttgtttgtggcttaagcaaggacattaatcctactagatgaaggggaagttggttctgttgtcttaagggatgcccccttgtgattttggtcaactgaatgaaaaagaaaagatagccttggacttttttttcatgggaggtttggaggtcaagcatgtagaaggaaaaggctgtagtcatgaatatagaactgtctgctctccaccttttcctcactctacatttagtcatcacactgaacaggatgtggcctgctgacagtgagtagctgaagtgcctgtttggtaagtaggttagcattcatcatgaactctgaaagccatttcagagtttggctgctgctctgaccctgctgtggtacaaaaaacatggatttttttttttttaactggagtaataccaaattccctttagaagcttgaagtttgatactattgctttccccattataaggattatacagtattaattaattataaggcccaaagtttgttttggcaaataaagtattattctctatcatcatc

SEQ ID NO: 9000 - DNA, 1265 bp, Homo sapiens; identical to SEQ ID NO: 8999

SEQ ID NO: 9001 - DNA, 1265 bp, Homo sapiens; identical to SEQ ID NO: 8999

SEQ ID NO: 9002 - DNA, 32694 bp, Homo sapiens
caccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccttcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccggtgagtgaggacgcgcccctccgccggcgggcgggacccagccggggcaccgggagaccccgaggcgtaggtctccgtttgcccacccgcctcctaggaggcgcctctcggttctcctcgccttccctccctcccctccgtggtggcgcctctgagctgtcagcgccgaggctaaagggagccgggcttggggaacagcggggttcggggtgccccgacgcctcgcctgaactagtcttctgcccctcactccgcctcccccagagccgctgcttcgcctcgtttctcgccctcttgacgggcgccgaggtgcgtgggcttctgagcattgaacaatggttctgcctcctctgccaggcgcagtgttgggaaggaggcagagggccaagacgtgtgcggcagcctcgggcgcaccctcgaaccccggggagtgcgggagcggacggggggagaaggtgagcgcctccggggacgcggagcgccaggggccggccgggcttcagagtcttccggcggccgcgagctggcgcacgttcggtgggcggcggccgggagctccgcggagccgagggcacccggactgcgactccccacggcgcggggcgcctctccggcgtgcggggtaggggagcggcggggctttacgcaggactctgctctgggcgcttctcctctcccttttccagcctcgggcggcgtttggaaaccgctcgggtctcccgtgtagctgaacgcggagggggagtggaggggagacttaatcaggttagtttgctgaccctccttcccggtgacgtttcctcgagaggaattgagtcctaggctagtgactgtaattagccttcattctacacaatagctcaaaggagcagcgcgagagcgagcgtgtggccctgtcttgttgggaagggcggcggtgactactgtcggtccccagactctgccccgcggcctggggccccgcctggtcgtcagccacgttcccacttgggcctcgtaactttcctggacaggcgacaggaagcctttctgagaggactcagtcggaatcctagcgcgtccccgaagtgatcttcagatgtgacgccgaggggcttgcttgccagctgcagggaattgggactgaaagccgcccaggcccttaacacccgttccagagtccctggctcccgtcgccgggtggcttcaggggccctgccggcctgcagtcacgtgctcctgaagtgagagcgaactttaaagcatgtggtcaaggagcctgtcgggcagcgcctggggtttttacgtctccgaatgcccctgccctttggttgccactgtccggagcgtgtgaactgggactggcctttccgccctctgcgattggttagcggtgcgatcacgtttaggttggtcacatggttccgcggactcttaagtgggcagcatgggcagtgttattttcaatggaaagtaggagactccacaggctcttacgggctgttctctcaaatgccttcccctgcctggactctttgaagaggacgaatgtgtagtgaacatggaatctgatgtgtaacaagcctgagagcctagaaaagctctgcttacaagagtttccaaacgctagcattaatcattaatagatgagtaatactaacttattaaacgatttctcagtatagtgccatgacttgcattatgccttttgtaacatttcaaaacgctaaggtataccagaaggagggacaattatccaggaaggtgagagaaaagtttcgtttttgctgcatgtcccttccactagaggttaactttaccttatagaatgctaggaatgcacctaaactactgacatgagttagtcaaagccagatgttcaccttgtattgggcaggtgaggatccttttcactttgtcacatgtgaaatatttgacatgccatgaacaatggaaaaacaaattcttcaaaggagaggaagcagattcttccagaactggaggaaatttgggctgaggcagttattgaccctaaaccaatcccaaccggcatctgtcttaagttcaaagtctcagggcatgtgggctgactttctaccctggagcttctacacataccccttctgtccactggcacatggtgctgttccacaatactcctggacaagacaggtgaacactgagactctggcaaggaacttaaggctaacaagaagttggtatacctgattgcacaattcctgggggttctgggacattttccttcagcctaagtagtcaagattaagatctgtggtatgatatattctttaaggccagagtctaaaagaaccaaggttttttgagagctattcatatatggctagcaactagcctaagaatagaaagaaaattccctcattgtgagaagtgggttggtggtactggtggtagtaatagacctggaggtaggaaactggttggcatggaaagtaaacttggctcatccagatagcaccaatgaaggtatgacgatgatagtaccccttatcaaagactgatcactcatgtgagcagggactgcgtaaaggaaggtcaccagccaagccctccttggcagtaacagcttcatgaaatccagtgtagctttgttccctggatcaccctcttgcccactttatgtggcatttacctatagtgcctgtcctgtgtcattttgattgtttgcttttatggcctgagtccccagatacttaaagcatgtataaaggtcaagtagagctgccaaatattaagactttagtacaatagactgctatttaacactaaacattgctagcaaaggtgacagtctccatgctcaaaagaagtgaagacctgatccaagtgtctctacctgtcataaaattgaataaccgtaaacttgacttgagtagtttcattacagttttggaagaggaaaaaagttgttacaagccccttctgctccaggagaggtatcaaattgataagacttaacaagaactcctagagtagaacatgaccataagatcaagggaacacatagtacccagccgtgtggcttcgggttttgatcccaaaccttgaagacttggcacacagcatagaaatacagctaattcattttaaatatctagcccattttctgtttctcacagaatgtaaatttgttcttttcagtgcagggaaaagtgtttaagacaaggcagttgcctacgtgacttaaagtaatgattgcattcactttggatactgactttcatttggaaaaccaccttcacatactagcctataagaaattaaatgtattaaagggcttgatgaggtctataatgatgttcgttgtaaatgtacctgccttagggagctccttgtggtggctaatacaactgccctctacatggttagttgataaattcaaaattgcttagtttggtccctactaatttaatctcaaaagaatacttggacaacagagtgatagactactttcaaggcaaacagtccaaaaatactgtctgctgaggttatgggcgagatatacttgttaagcggaagtaagtagtccagggacaattttttctgccacctaaagagttttgggctagaaaatctgaggactgatagtttttctgaagagttggggcagagtctaacctagctataggcgaatctggcttttaagtaaaaatcatctcaattttactgtctgcatttttcaaactaaatcagtgtctctttgctaagttcgtctattggcttgcaacaaaaactctaaacactgttaataccacttagttaagtacactaactgcactgcaggaaccaaatgagatggcaggtgataacacaggttaagtgtcctttatctgaaatacttgaaaccagaagggttccacagagtttagattttttcagattttgggacattcacacatacataataaggtatcttggggatgggacccaagtctaaacatgaaattcgtttatatttcacatacaccttatacacatagcctgaaggtaattttatagactatttttaatgattttatacaagaaacaaagttttgactgcaacttgtcacgtgatgtcaggtgtggaatttccacacttacggcatcatgtcagcactcaaagttttggattttggagcatctcagattgcggattagggatgctcaacctggaccataaatttagcatacttttccccttgagtgaagtctcctaggaaagcttgggcccaacagttattttgagtctctaagcaagagaatgcctgttaggtcctgtgagagtaagtgtggagattctgttagaaatgtttcaatgcttgcttagagatcctttgcctactttgtagtttagagatgctggaaactataagatgaagcctctggctagagcagctgattttgccaacttgggggccatctggggagcctttatgtatgtagacgaggtggtggggatggggggacttgcaatttgccaaccaagggacataacaaagcctcggcgatagacagcatttgtgagttacatcacaagtttgttagaacttaatagttctcccacatgctgtgagtaaacagggtttctattttatagactgcctctaatctttcattttcttaagaaagacttccccacatctgaggtattaactgatctgtatgttcactaagtaggttgcagattgatgttggtcatctttgtgcatcttctggaaaccacttaatgtacatctactgagtacctaccatatggcaccaggcatggggacagagtgaccatagcactggttccttcctttgtggcacttagtctagtaggggaatcaaagcaggaaacagccaaagaccgcttggaatagaagctctgaagaggagtgagcagatccagtgtttaagacttaatcataaaagaggcagatagcagctggagatttctggaatttccatatgctatctgggttctagcttatgaagtttccctaaaattaccaagaacttagactttaatttcaaaaagccagaaataattctatgtctgcagataatcctacaaaagtgatatgactaaagcaacaatggattactgccagtattaccaaagagcattaaaacatgtcagaagtaaaatctgcgtctgatatatcacactcaactttaccagttagccgctgctaaccttctcaggtgttggaacctctcttttcacatggaaatgaagccaacacacccaaagggacacactcattctgacagacaagtgtgtgaaaatgcactgtttttaaatgataaattgcaacaaagaggccgggcgcggtggctcaaacctataatcccagtgcttttggaggccgaggcaggcagatcacgaggtcaggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagaatccatctcaaaaaaaaaaaaaaaaaattgctacaaagatgaggtgaaggtaccctcataggcctagggaacagggacctttataacctagagtctttcaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaactgcagcccatgccttaggggatctctgtgtctaaaggtgaaaaatggtagctgaactcatctccttgggtgatggctctgtgacagggactattatgagaaagcagccagaccatacctagtttttccaaaaaaggcattgaggcctcattcaagaatacaatctgagcccactcctggtgaatgggtggacaagggcaacatgaacaaactgagacaaagcagccatgaggaagggcaaagccatggggaagtgagtgggtcccctttgagctgttagctcagcccgtatagcagatggtgggtagtgaccaatagggaaaagtctgaggaaattagtagggaacttaatcctagagatagtggtaagccaagaaatgaccccattcttggctattctaggttgcttgaatcactaggttgcttgatatgggtagagaatgtggcagcctggaggcaaaggaacaagacatttaaattgacatcaggtgagaggagggcttgggcatagccagggattgatggccaaatgtcagggaagaatttgggctcatttctggagtactgatttagagtaagtaatggggccaatcaaagatagactacacagggagggaaggatggattttagaagaacctctgcctagtaagacacccaaataaattttttctgcaaaatagttttgagggctttactcacatgttactatcatgtgtattgtaaaagaggcatttatctcctgtgtccctcctgtgatgaacattaggccttatgagggtgttattggtatatgctacaaccctgaaaatgaaagagccacttacattatgggtagaagctgtagcttcttaaccttagtgcagtggttctcaaagtgtggaccgaaattggcaacattaattcaatgttaattgagttcatgtgtcaacattgactcattagaaatgcaaacttaggccctgttctagacctgctgaatcagaatccaggctggggcccagcattctgtgttttaacaagccttcctggggattctgatgcacacgggagcttgagaacgactgacttagtttaccactcacagaagctaacgattttcaaggtatatccgatggagggcctttcctctgacttgaaccctagacaagaaaaccaagagctataatccttttagaagacttgctgaggaattctagaaacatttttaaaaacttagaatgaggaaggaaagcaggcctccatctcaacaacaaggctaaatctaagttgatgcttagtaacacagtatctagagccagtgcctgggttcaactcctagctctgcccagggcaatctgggacaagtgactgtactttccttctctaccaggtttcctgatctgtaaaagaggaataatagggccaactgtgcaggattaagaattttaaaagctaagagatgtgaagtcttagagcagtgtttgaccaacaacaaaaacgatttgattatgtccatgattcttaagatcaatttgatgtaaatggaaattgaatgtaactgacaattgaactgtaaaattcacttatttccatgactcagaagaattagcctacatattcaccactttttagtggcccccgaactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccaaggagctgggattacaggtgtgtgtaatgcctggctaatttttgtatttttagcagacactgggtttcaccatgttgaccaggctggtcttgaacccctgacctcaggtgatctgcccgcctcagcctcccaaagtgctgggattacaggcatgagccaccgtgcctggcccaaactggttcttacaatgtttcagaggctgactttaaggccagagcacaatctttgtgcttgacagctcagaacatttcccttaacacctgttgtggtactttgcctcttacaaacccttctccccttaggaaaacttttttgctgactcagaaatttgcttgtcctgaaaggagttttagcttacaaatagaaacactgtcattaaagtggcaagcagtagaagtgaactagactaaaaataaatgcccttggtggccccagaagtgccaaaacaaatggacggaaggaattccagcaagtaacacccatatgctcaagcaatgagtaagggcatgagagatgtaaatgcttggccctggtggccccagcagtgtggcagcatgagcctctgtgcaggctgaagtacgctctgagcctggtacccagagacactttctctatattctgggcatgcatcttggagtgctcctgccagggtgctgctcggagccccatagggagatttgtagtccgtttggaaggcttggtatttactcgaaggcctatgcagttttttactgaagcttatgtattagtcctccatgtcaaccgctacagggaaaattagacaatggcggctgacttctatatgcattaaaaaccctgagtttccctctaggacattggtctagacaaggaatttatgaaagagacctcaaaagcttaggccacaaaaacaaaatagacaaatgggacttaattaaactaaaaagcttctgcacagcaaaagaaataatcaacaaagtgaagaacaacctgccgaatgggagaaaatatttgcaaactattatctgacaggagactaatatccagaatatacaaactcaaacaatggggaaaaaataatcccattaaaaagtggagaaaggacatgaatagacatttctcaaaagaggacataaaaataaccaacagatacatgaaaaaatcgttaccattactaatcattagagaaatgcaaaccaaaaccaaaatgacatataatcttataccagtcagaatggctattaataaaaagacaaaatacaacagatgttgctgaggatatggagaaaagggaagtcttatacactgctggtgagaatgtaaactaatacagccaccaaggaaaacaatatgcagatttcccaaaaaactaaaactggaattaacatttgatccagcaatccctctactgggtatctacccaaaggaaaaatcagtatatccaagggatacctgcactggcatgtttattgcagcactattcacagtaacaaagatacagaatcaacctaaatgcccatcaataatgaaagggtaaagaaaatatggtacatatacacaatggaatactattcagccatgaaaatgaatgaaatcatgccatttgcagcagcatggggatggaattggaggtcattatgctaagggaaataagccaggcacagcaggacaaatatcttatgttctcaatcgtatgtggaagcttaaatatttcattccatggaggtagatggtagaaagatgacagagactcagaagtagggggaaagggagagcagatgaaaggaagtgggttaaagaatacaaacctacagtaaggtagaagaaataacgtcaatgactgtagttaacaaaaacgtgctcgcgtgatggacaccctaaatcctcggatttcatcagtatagattcattacatacatgtaacaaaattttacatgtacctcataaatttatacaaacaccaccaagaagaaccctgtttttcttggagccagtgaactgccaatgtgtctgtgtagcaaagttaactacttagagaagcaaggctcccaggaaaataggtccttgaagttagtgtgcatattctatagtctgattccatctatataagtgacagtaaaagtgagaattttttgacgctccaggaattcattcattacaaatttaaataggcacataagtgagtaggtacaagcgacttccaaccccctcacccaaaggagcagagatattctaaggattagagctggaagaaaacctagacaatttcttaatagaacccttttcaaattcttacaccaaaatccaatattcaaaagaaagtcttggtagaggcagaggtggaacacccagggcctctgctactgtggcctttccctccacttcaaccacccctctagcctgaggcattcttgtgaaacctcatggctttaaggaacccactaacaattgcattttgccccatcttctcacctgtctgagcagaaatgcctagcacttctacttccaaggtattttttgaggtgtcattggctttagtttagcctgaagaattaaaagaatctcgagtgtagatgatttcaagctcaacttgttccctttatgaaagtataatactgaatttgagacgtaactttcatggatggaaatagactgcaggtccacaatcctataatcccaaagctttggaaaccaaaagcctcttaactcatttggtgctttcagttctcctagagctctgcacagcagcagtcccagctgagcaccagaggtggataggtagaaccttttaaaaacttgaacagaaaacttaacagtgttccagtcaggtggctaagggctgggcattcgatttagtgtctgagctctccctctctgtgggaagcagagaattaaacagaactagggagcactttctgcccagtagcagtccctcaaaacaaagtgcttaggaaactaggaaacgaagaggcatagccataaagcttaaggtctttatttgcctgtctttaaagagtcctttataaagccagcttgtcttcccacccccaccccaatgtcattcttttaaacaggcagggacattttagtagcacactgtactcctaatgcctgttgctactccttattggagagagagagagagagagagtgtgtgtgtgtgtgtgtgtgtgtgtgtgtgtgtgtggttgagagagagggagtaaaacacagctttatgatgatcaggcagaagcttgagtaaagtggaaatatctcggataagaaaagctagaaattaaactcctttttggcttcggatattttcttagtagaaaatgctgatgcctgtcctgagtctcctcaatatagactcttagagcagagctgctaggattttaatagaatttattactgttgatagcttgtatattacaactaaattcagagaccctctttaaggcaatagtagagtaaatatcagccttgggatactgtatgcccatacttaatcccaggccactctgagtgcctaggaaatctgtagcttcaaactcattcttaaggaggttgtcttccaggtaccttaaccctgaggtgggaaactatcaattgacattgacctttaagttgctattcaaatctgattacaaggtttccattttgattatgtagatatcaatgtcaatgttgttgtctcattttgacttaataacctttggtaactaaaaccttaaaaaaaaaatcagaggctttcagtctttactgtatcttaactccaacctgactattctttccaagtatatttatacctatgttctcagactacaaatcattcttttcctgattactcaaggtagagtcttaccactttcacagtccccaaaggtagtaaggtcatatagaactgcaagacacgtaccctcagcattgagaatattgcaaacatattaagaatccagtggcaatgaggggagaggggagaggcaccaggtacctcagatttggtttagcagtataaaacaacacaggtgatgcttcctgacaacaatctctaccctcctctagttccccttctaaatccctagtatattacaaccaataaaacgtgaagaatgaaaaagtattatgaaatgaaggtaggaaaccattctgctttgtagctgggtcctagcttaattagactcatgggagcagagtgatagatgcagttttaaaagcaacatatttaatatccaaggaagtaaccacacccatatggtcatcttgatttgggccaaattttaatctccctgggaagagccacaaagcacgaaatgctcccagacagcagggagtagctgacactagggagaccaactagggtattgtgcacgtaacacaagagttccagtctgtgcttgtctctgtaatatcagttcttatgccagcatgccacagctgcaaatgctgaaaggtggcaggaaatcggaaggccttctgctgggacaccctccctaagtaatctgcgtgaactatatgattccactgtttttctcaaatatttgcagtatatttgctttaagggccacatctgtgccttttatcgtgaagcaatcacatccgccagaaggacggaactgctaatgataggaagcacctgaacattagctggcctgtgccgggcaaaacaccaactgtcccacttagaagtcttagttcacaccattgtgtgaattaaatatccatacattaagcatagaaaaccagattcagagaaatcgaaactacatcttcagctccacctcactttcctttcctctcctctttaaatgacaaatgatcttcctttccctcttaactatactttcttgttgcttttatcttggagctgttttttaaagctgtgtttttccaattagacctcagtttctaagaggaggaatcatgtattaaatctctatttctaccctattcttgctgctccttctaaatcttcttcactgtgcttgtaatagaaacatcattaatggataatagtatggatgtggacaagaaatgccattaaaggattaggacttggctgattatagccacacacgtagtttcaacaaatgagagaaatgagtccacaggcagagatgatgccccttgtggtctctgggcaatctggattccttctattttcgtctggctccatttgcccgagatcactattccagccaccatgcccaattttcaggtaccaggaatgaagagatggaaagaaaatggatcctctatcctcttaaggacatttcccaaagttgtatataccattttagtttacattccattagtcagaatgtagccccttggctgcacctcactgagaaagaggcttgaaaatctagtatttagtcttagcatgcacccagctaagaacgcaattactgtcagtcactggctgaagagccatcctactctggcccttaggatgtcatagcctgccgagtctgcagtatccttctgagaaggtccccatccatgggtattaggtatcttgaatctataaccaatccttgctttaccgaatgttcccttcttattctagggagaaaagccaaatgtgaaccctcccaattccagtgcacaaatggtcgctgtattacgctgttgtggaaatgtgatggggatgaagactgtgttgacggcagtgatgaaaagaactgtggtaagtaaagagtttgatgacttatgcattttgttaaaatatgatgttatcttagtctgcaaatgtattgagattctgaaaataaaatccacttctaacaattgctttgaaagaatctatacttctctgtgtaaaggaataaaattgaatgtttgacgtggggttatcaacttgagaatggaatgataaggtgatgttccatttaaatgacaggacctagtttatcttagatcagacaaacgtggaataggaatctgggagaagggagaagaggaccagaaatagagacaaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgcctacaatagttgctaattctaaagcattagcagggcggaagacattctctccccaagagaatggggatacagtgtcacagccatcaatcagcatctattaaaagatcactgtgagaaatgcctatgtatgcaatctatacaacctcatgtcaagccaaaatagctgagaactgcatggcaagattacatttacataccatgaatacatgctgaaatttgctctacgatccctttgttcagggttgtaaacattctgaaacaatattctatgtgaatattggtgctaacattgtcatttatcttttaaaagatgttatataaagatgttcactatacaaggtagaaatacagaagaaaagtagagtctaaatgtaggtttcatcaactgccatcttgttatgcctttacctacttcttcatgcatcattattaaaatgctataaagtatgcatcatggcagaccttgtgctacacctgatctctcagagcagtatcacaggtgttttcatgccaatgtgtaaagcagatcagtagctcctttagaagcataagaaagtccattctaccatctcagggaagaaacttacatccagtctcaggaccaagaatagttctcctgtgcaacactttatcatcatttgcattttaacactaagattttaatctattccacaagacactgagtctcatgctatttctgggttacctaggtaatttagttctcttactaaatatctccttagagagtcctcactcttgtcaactattttcctgttgtaagttgcaattttttttcctctcttctaaacgatatatttggcaaaacccattgcttgttcttaaaaagtaattattctctttgtgttgcacaagtctttttttaccatgtgactcagtaggaactaacctgggtcaacttgggatttttctaaaatagtcttgtataagtactctctactagccacatggtaggagagtttggcaaagaaaaagaggtagatgtatatctaatcaagatcatttgaggcaggaaaaattatatccttagccaaaatttgtctctacttcctgtgtgtgacagtagagaaagaaagtagaaatattacaatcagggaaggtctgagtgcttactttgtttctctatggaagaggaaagctatagaattacttaaaacttccaaagctgcctcctatttttagtctaacctcttaatatggaacttggttacaatatttagcttagttctttatttccagtatgtcaatgggcatagtcaacttaaccttagattctattagccatgtgcttctgttggtcccattaactcattcttttataatgttaggctgagctaattaatcagcaacctaagtactctaaatatgtaactgctaattctcttcctctgtagcacatctaaattcctatttgtctctcaaggcccagttcacatatcctttctttaccctcccagtctatgctccaaatgaagagagagaaccatacggcaatttgtctgtctctgtttatcttttgctcaaacactgtggtatacagccaatctttcacatcctccttacgttttctaagacttaaaatcatggagggccgggtgcggtggctcacgcctataatcccagcactttgggcggcctaggcaggcgaatcacgaggtcaggagatcgagaccaccctggctaacacagtgaaaccccgtctccactaaaaatacaaaaaaatttagccggacatggtggcaggtgcctgtagtcccagctactcgggaggctgaggcaggagaatggcgtgaacccgggaggcggagcttgcagtgagccaagaccacgccactgcactccagcctgggtgacagagcgagactccatctcaaaaaaataaataaaaataaataaaaaatcaatcaatcaatcaatcatggggtctctttacagccattccgctactccctcttttgtagcttccaaagaatatcacaggttgaattatagcaactaaccctgcagaccctctgacttcttcctccatgctcaggagaacacagaccttgaatagcacttaattcattaacattagtgtttgagtttttcagtgattttagaaacaggcatgaatctaaagctagcatggccagtcttgtttccttggctgtgtaattcaaggagataatcctttatagatcatcataatttgtcaacccatcttgagttctagaaattaactgtaatcactgtctctctcctttacaatatcttactctcaaccagagtggtccaagggcacactctaagctctgagagttctacctgctttaaaccagtgatttgagaaacagtccctttcaaatgttcatcaaattgtgaatttttcacttatttaccttcacagaatatatgttatagaggaatgttttaaaatagaaattgggtagaaggtataagcatataggcaagaaagaatataatctaagaaagataagcttagggtatcctgtgtggctactttatatcaagattcatcctgctccgtgattccttcatgggtaggataatcaagctgcccgatttgcttaggacagtcctggtttatgcttatcttccagatataattaaaagtgtcccctttctgctgagactgtcccagtttggacaaaaaattgcatggtaaccctaagtataggggaaagacctgccccaggaagaattagcaacagaatcaattcctctccttaggctattttaacattagcaggcagttatggatattagcactgacagcttcaatgacttttagctggttgatgttagcctaccccttggctagaaaggctaaaatcttctctcccttgaattctaagtacaacatctcttgttacactgattgagttttctcccctttctacctgatgagtttctttgcccctgtagaccagtatgggtgacaatattcagtactggggtttggccttcattctccacactaaacacatgtgttgttaggggatgccccttgaacagtatattagtcagctcagactgctgtcacaaaaataccataagtgggtggctgaaacaacagaaatttatttctcatagttgtggaggctgagaagagacctgccagtagatctgatatcaggtgagggctgtctttctggtttgcagatgaccatcttctcactgtgtccttacatagtagataacaaagagagagagagtaagcgctctggtttctttttatgagggtgctaatcccattcatgggggctccaccctcatgacttaattacctcccagaggccctacctcctaataacatcatgttaggggttaggatttccacacgtgaattctgggtggagacaaacattcagtccccagcaagcagttctactatgatccagtcagaagatggaatgtttagctgttaaatgaagtacttgaatgacttggaagaaatgcatgtagaaaatgaaagtgttacttaatctcaacattataaaacaggcaggaagttaaatgtaaggtatctccgagttgtaagataatgggcaacctctgtctgaccttgacttcagtttcctccaagtctctcaaatgagcatcttcctcctctgaaaaaaaataataatttttctgaagtttcccctggatattggcagttgagtgcccattgactcagcttttttttagagcaaaacatgccaaaatgcagtatgagccctcatgtgaagctagggctgtgggtaaatgacttcaactttaacccttcaaataaacgtttgtagtaaagaagacgtgtgctgaatctgacttcgtgtgcaacaatggccagtgtgttcccagccgatggaagtgtgatggagatcctgactgcgaagatggttcagatgaaagcccagaacagtgccgtgagtgtaacttgctttggccttgaactttgccaagttgttcggtgtctaacatttctaagtattgcttaatctcctacttggtattcatttttctttgcctgccttaaagtttaggtcaattgactccaagggcagtcaaatcattaccagtttatcagcctcctttaaagaatgttctccctggtccaacaagactgacattctcttgggtagcttcactattgaatacttaaaactgaagtcagcagattcaatcaagaactccttgactaggtgcatagatttcaaatgtctgtttataataactgagcagatggtactctggtcctggaagctaagtcaagaagtgagggttccctatgggccaagcaaaagcttttagaagcacagcttatcatactattaaaaagctattactgaagaggtaaggtagctagtaattgggtgatatagtgactcctgacacacatgtaacctcaagttactaaaatggagatcttacagcatattcttaaataagagaaacttcataggtatgcaagtatatacctgtgtccttaggaaaaagtctatgagaccataaagaatgatggtttgggatcatataaattgagatcacacgaatgtcaaggcaaagaaagtcttagagtttgagtcagtagaggcctgcactggtagaaacactaaaaaaggactaacatgaacacagtttaggtctaaagtgtgattatgaaagaaaatcaaatagaaaggaagataaggctgttactttcaattttctagataagaagtgaggggagtaatattggtcaaggcaagtgagttcaaggcctgtgagctaaagacaggttgtgtaaagattcagcctcaacttttagtggagaatgacctggtcaagtcaagcattagggcatgcttctactttgcaagatgtcaatctaaaggacattgtgaaggaggcccataaaggaatctaggcaatagaagattttgtaggtgtttgaccatctgacttttcatgtatttgagattagatgacaatatctaggtgtgcccacttgacatccaacagataaatagtggtctaggagcaggccagccaataaacttcaccacgccaagtaaaacaaaagccagaactgagcacgccatgggaccttgaaggagtgacgtggtcaaagctgtcacgtacactgccaggtagcataggttggcacagcttctaaggagtggagctgatgaaagagctccccgggcttcagccagttagtagaatttcaccagtgtgccaggctactgagtcacaggtattagcgcttccaggcagcacaggagcagcagctttgcattgatcagttctgaggctcttttgagactgtatatcatcaacagatatgagaacatgccgcatacatgaaatcagctgtggcgcccattctactcagtgtatcccagtgtcctggagatgtgatggtgaaaatgattgtgacagtggagaagatgaagaaaactgtggtaagaagatcagtgttgagtgacgtaacccaaagacccttttcctaaaggaagggtgggcaggggaaactaatctaagcctgaagacgcactgacattgactcacttttcagtgacttcactatctgctcaattacttgtccttcataactgccctaaaaccctaaaagacattcatgtggcaattgaccatcgcttggtgtttcttttaggcaaatagaaataagaaggtaagtcattcaaggcacttatatatagaagtagctcagggaagcagcaattgtgtgggcttttgttttgacagtaattcatgtgtcttttgcactttggcacaataaaattagaaggtgagtagggttggcaaacacattcataggtctaaatttgattgggttattggaataaattatttgagtattatacaagcatttctttgcccatgaactagattctggcataactttcccagaaaaaaaaaaaaaaaagacacagaagcatgaattaacatcttgcctcagatacccaaagaaaagtctacccaactggtgatacctttgtctcctgttgcagttcctgtctctgaaagctaactctgcttcctattctttcatgtttctggtcttggaaaatctttaataaaatgctgcatgttgaaggtgagggcctgggaaaatcactaggttgaacaaacagtgctttgaatgttctttcaagctactgccctttttatagggcctctaaaacctacagctcccaagtctgacaagcatgggcctcctgatatggtagtagtcaagggagctcagggcacttacagttgaaacaccagtcttgtgtgtagaagtcgcctcctgaggtcaataccactgcacctagtccaatgagttttagtgttcaatcctagaattgggttttctgtattggtaagccctggtgctgccaagtgtttcccttataaatctagactttgcttcccaagagagtcgtggtctctattctaattgccaccaaattgtgaccttgaaacatttggcaggaatttaagtcaaagtaccaattggctagtaggactagcttatcattgtcagcatacctgattgttaaatggtgattatagccctggcagtgactttttcaaaatggaaagtgtttaagacttgttattcctgatccttatttaaaggaccaaaaagaggaaccatatatggtggtatgtggttcacctcttttggtgacaaagtcttaatgcttgttgtgagtattacgttgcatgatattctcaactagtgataagatctgacaagcagtatgttgattcaaggacaactcaatctctgccttccaaattgaaatcccttgttacagtttgttatttatgatggccacttttagaatcaattgtggttctcatctcaaattaatttccagtcttcaactattttcttggttctttatttctgttcttcttatttattgtgtgccttcattttttgtacaatgagactgtacaaaagttcttgatttaactccattgtagcctttaagttgggctagtaagttaggattaatgaataaagatcaatgtattagattttgggacaagaatcttgaacggaccaatcttgatgcattttcagtggggcatcctctctcttaataggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtcgtaagtagctttctagcatggcatgttcagttctcttccctgtatcaactgggacaatttgctggcttcattccatggtgtttcctccctttgtagcctctcgaacttgccgacctgaccaatttgaatgtgaggatggcagctgcatccatggcagcaggcagtgtaatggtatccgagactgtgtcgatggttccgatgaagtcaactgcaaaaatggtaagggtttcttcttgttggttaagcaatggattgctctgaccagacccactcatggaatctctcttctttgtttctctttgtagtcaatcagtgcttgggccctggaaaattcaagtgcagaagtggagaatgcatagatatcagcaaagtatgtaaccaggagcaggactgcagggactggagtgatgagcccctgaaagagtgtcgtaagtgtacttgttgttcaagtacagatcctggaagtttgacacaatccagtatagctaacactgtgtggaccccccgtgatggctagttaaacttttgaatgtactgaagttcaattgtagacttcagagtgaaactttatgacttaaaagcccaggtaggacaaactagtttatagtttttgtttttgttgttttttttttttttttttttttgagatggagttccactcttgttgcccaggctggagtgcaatgatgcaatctcggctcactgcaacctctgcctcccgggttcaagcagttcttctgcctcagcctcctgagtagctgggactataggcgcccaccaccacgcccggctaatttttttttttttttttgtatttttagtagagacagggtttcaccatgttggccaggctggtctcgaactcctgacctcgtgatccacccgcctcggccttccaaagtgctgggattacaggcatgagccaccgcgcccggcccaaactagtttatagtttaacctccttaaagataactgatcatcaatagagaaacttgactaaatgcttgaccagctggtaacttgccgaggagttagataatccaccctgaaatatatacctataaaataaatgattaggtcttagacaaatcgtgggtttgaccaggccaactagataagttatcacaaatagcctgggttttaaatgtgaaagatattaattgaaaataagttgtcaagtgactactacatttttattccagatataaacgaatgcttggtaaataatggtggatgttctcatatctgcaaagacctagttataggctacgagtgtgactgtgcagctgggtttgaactgatagataggaaaacctgtggaggtgagtctaagaagaaaacctggaccctgcaggtgatgggaaaggatagtatgtacctagtaaggtataggagcagcaagactaattctgatttccctcccagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggtaaatgaacttggactggtatggctgttgtacctttatgagtaagtgcctctaaaaggtacagccagtgactacaatagtcaaactaaacatgaaattgtacttgagaacaatgctgctaacctcataatacagcagtataggtcaaatagcagatctctcccctagatatgtaccttgatcattccttttgcatatgataccatgaatacctaccaggtttgcatgctctgtttccaaaacttgagtccaactcaaacaagtgacttattcatcactcaccctgttcttgaaggctgtaaccccacgactgccttcctaaactgtaggaagcacttgcaggtcccaggggcaggaactccagaacagatactactgaggtattccacaatacctttattttctaagtgctcctctgctgggaggaggtggtttagaaagaccttgccttcttaaagcaaaactaagtaacccagacttccatcttgcaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcaggtaactttcagttccttttgtggtgtcttgacataagtcattgtcacttgggaagtgatctgtgggatagtttggaggagtttcttttgtgtctagccccatctagcatcgaattacctggggacattaaatctaatgctaattctttattaaactgttatcacttcctaattagaaactaacaattgtctatgaagtaaaagatgacatctttcatattttttatattttctcccttttctctacagttaattgagaactgttcattgttgctacaaatagaaatggtagtacagccttttcttaatgggaactatagaaactcagatgatggatactgaaacaaatagcttcacttagaaatttgttgttcttgtatatagaatacataccagcaactagataatctacagcattattaatttaggatcagtaagcagcatggttaaataatttgagtggtgagctgtggtgttaactggatttctttctgaacaaagtcattgaccattttgtaagcaaaaagtccattctccaagctctaattgtgtcaaactcttaaatttcttgtgacctattctgtttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctgggtttgtagtctgttttccatcacagactttggaatggtatctgtgtaggtcaggagctttctcatacctgaattagtactcaaatctcaaggtttatgagccttctgcaacaaagaattagaattctaatttaagatatcagttttgccccaggtgagtgaccctgggatgtccttatctatatgacaggtcctcctgtctgactctcgtatgactgattgctggctgacattaatgaattaacattcctgatttgatgtgtgtaccaaaagctgtatctgaacccttttgtccacccagtttctacgcaagtgattttttaatttttgactgaaagctttgctgggctagctctggatgatcaaacctaaacgacagcctgaattgtgaggatttgggtaaccacattgcatctaagtgtgcaagttgtctgaaagtccagcagaaataaacagacctttctagaaacatttcactaagggggttctgtaaattgccactaagtaacatagaagagcagctcaggaagttgactaaggctgtagttgtcatcacaactggcccccgtgcagcctcattagaactcagtcagccagccaacccctgctatgaaatttgaaggatgttcgtcttgcactcctctgtaagaactgaccttttaaaaaggaaacataaccttgtgactttgggccgaaatttaaatgtcagacaaacatagattattatagttaataatgagcttgtagattcttaatattcaattttatttacctagaacataatttagacccttaagtgttactatttgtcactagagaatgccttgagttttctgctcaaattttaaatttttgtttccagctactacaactttattccttctaaaccactgaggcttatttctcatttaatttttcacagctttgtttactggtcagactggggtgaaccagctaaaatagaaaaagcaggaatgaatggattcgatagacgtccactggtgacagcggatatccagtggcctaacggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattaacaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagttttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcatgctgcttcgcaaggtttatggtgaccccgttaagaaaccctgctggggaaagaaccgtgaaagtagattattaattcattagatatttttaatggaagccagagtagtagtggcttgtcatgtaatgacaattcttttcctacctagaccttataaaaagtcgcctctattggcttgattctaagttgcacatgttatccagcgtggacttgaatggccaagatcgtaggatagtactaaagtctctggagttcctagctcatcctcttgcactaacaatatttgaggtaagatgtgtctcacatcaaagtgtgtacctttgagctactatatcactttgagaagaaataacagacatagcgggaggagggaagagcagctgaacatggcttgagaaactgctttcacttaaaacctggtacaaatcagacactaagtcccagaagcactccacacctaaacttgattcttttacagttttatatccagtgtcccagttcagcattcagtaaacttagtccattaaatgagaagtaaatgatgatgaccttagaaatggacttgtgttaatcctggatgtacatgctaattgtgggcttctgttttaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaccgtggagaagcacagtccttaataactactttaagggaagcagcatgacacagaacctgctggatgtcagtagctcttggcaactcagttttctttaaaagggaacttttgccctcctgtaccctaccttaaacatttcacatgttatttttttatttctgctgcctcagagaaatggcttctcaacttcagctcctggctttcctcccaagcctcagtgtcagagcttttatttctgtttcattcatgtccccttggccttcagcccctcttgccaagactattgcagtagcctccaaagtagcttttgtgctacaagctttctctactgttagtttgctaggatttttgcaatgaagtaccacagactatcttaaacaacagaaatttattgtctcaaaactctggaggccagaagtttgaaatcaaggtgccaggagggttggtgcctcttgagggctgtgagggaagggtctgttccaggcctcttcttggtctgttgatggtgctcttccccctttgtctcttcacatcatcgtccctctgtatatgctcgtgtccagctttcttgctttctttctttttctgttttttggagactgactcttgctctgtcacccaggctggagtgcagtggcacaatctcggctcactgcaacctccgcctcctgtgttcaagcaattctcctgcctcagcctcccgagtagctgggactacaggagtgagccaccacgtccagctaaactttgtatctttagtagagatggggtttcaccatgttggccagactggtctcgaactcctgacccaaagtaatctgcctgcctcggcctcctaaagtgccggaattacaggcgtgagctgtaataacagtcatattggattagagcccaccttaatgacctcattttaacttgattacctctgtaaatatcctatcctcaatatctccaaataagatcacattctgaggtactaggacttcattatatgaattttagggaggaacaccattcaactcataacacctactttccccctgtgacacacctgatataggattgtgtagattctcaaacacatcgggttatattatctcctgctgaaaacacttggctggttctatctaaataaagccttcaaaccttcctaaggctgagtttccttccactttgttggagcaagtcaagagaaaaccaggagaacatgcctagtctcctttctctgagccttcacgctaaacctcgggcaaatagtgagagccagtcctggtccctcacctcccttccccacctcctcttttggcatctgtctcttaaaggcataacttttacagtctatctcgaagaggtcccttatctggtgtccttagagcatgctgcctgtacctgtatacttattcttccttgatactgttctcacttgaaggattagcagagtagacaagtttaagctcttgggggcaaggactcaggtcttcaacatgtagaacaaggctttatatatactaggcaccggaatacccattttaatggtattttttttcctgactaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtaaggcattttgtgtttcaaccacaagtagaacctacaacaagcaatataataagacacaagcttggatttttaagaattctgtcttagctaattctttgaatagatttgagaagatatctgctattgtatgccgggttatcatgtcatttctttagaactgactttaacccatttcaacattaaatgagtttataggagactaaagtgtcaacataccttacactaatttgtacctagtcccttaacagcactgagctagccaacttgcaggtaattaaatgaggccttaacatttttcctcaaaaggaggaggacagaaattatgcttaaggaaggccatggttacagaaacctcattgcctcagtgggtgacgctaccctaaaataacacttaggctgaatttgcatttagtcttctgttcttaacttttgattaagtggcaaattaaagtcatttgtgtgatcaaggagcttgtatggtgaggctgatgaggtttttattagcgtaattcatggtcaggcagggattagctcagtttaccaagaaattagttgcaagacagtctggtatgcctggtataccagagcatcttgagaacatttctcgtagtttccaggaacatgggatgttgtttagagggataaaatgtggttgtccatcattttgaattgtcaaattccaaacaccgactgtccttcccaaagtttcatgtatctcttttttgcatgaagattgctatttcaatgttgacacatcagctgtacaacttagttcagcagtggtttgtctattttacctggttttaaaataaccttttacatggcttgtctggacaaaacagctagccatgctggaaccctggcattaaccaggttcttggtttttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtagatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttccgcactgttaacctggcttatccccttttataataagtctctttaactagtgtactgttctgttccccctttgaaatgtgtgtaatgcttcatacagaggagatgcacaaatgcttaaatgctaagagttacaggacttgttgaggataaattaaaagcagttaagaattttcaaacctatggaaaaggacctctaaacgagacacgcaaattctaaggactttgctataaaaacctttgtcctaaatgaagagacccaagcttagctaacacgccaggaccacctgaatagctctccagaaccttctgcaattttaatttggtgagcctaaggtgggaccgaggaccctgcccttgcctggatggatgtggctagtccagctccagtgcacagagctacctctgggctgaacttgtttcaagctcctggcccatgtgtattccaacttctagttatcctagctccataaaacatggcatttttactaatgtcaattattatggattcctgaacgttattacctttcttgtatgttccaatactagacttagctcacttagctaccctctgatttttttcagtgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcagtaagtcagctttgtgtctttatacaccatggcttgaagtgagacttttcagaaaggagacctgggtgagagagagagagccattaggatgatggagttaccaaacacttcatctgctacctggctattagacagacagtatagcctgttagaacataagtcactcagttgatcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaagattcacttagccaaaattattatatgctttgctttaaaaaggtatcccaccgcccttagtatagctagcttttcttccagcaatagtcactcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaagcactctgagtgtttgaatgaccaactcaaaagcaaggtccattttaaagactagagttgccatcagtgagtgatcaccaagctcattctatacttcttcttttccacagatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 9003 - DNA, 210 bp, Homo sapiens
tggcatttgcttctgttccttgtatctgtggaagtcaagtagcccttctcaaaaatgagaagccaagctttaaatagcaaactacagggtattaaaagactaactcttcagttaagaacactgtagaaatggtagaccaacttaaagtctaccttttaacaatctttaccccaaacctaaagattctaggggtcacttatctctattacg

SEQ ID NO: 9004 - DNA, 210 bp, Homo sapiens; identical to SEQ ID NO: 9003

SEQ ID NO: 9005 - DNA, 7004 bp, Homo sapiens
ggtcagactggggtgaaccagctaaaatagaaaaagcaggaatgaatggattcgatagacgtccactggtgacagcggatatccagtggcctaacggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattaacaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagttttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcatgctgcttcgcaaggtttatggtgaccccgttaagaaaccctgctggggaaagaaccgtgaaagtagattattaattcattagatatttttaatggaagccagagtagtagtggcttgtcatgtaatgacaattcttttcctacctagaccttataaaaagtcgcctctattggcttgattctaagttgcacatgttatccagcgtggacttgaatggccaagatcgtaggatagtactaaagtctctggagttcctagctcatcctcttgcactaacaatatttgaggtaagatgtgtctcacatcaaagtgtgtacctttgagctactatatcactttgagaagaaataacagacatagcgggaggagggaagagcagctgaacatggcttgagaaactgctttcacttaaaacctggtacaaatcagacactaagtcccagaagcactccacacctaaacttgattcttttacagttttatatccagtgtcccagttcagcattcagtaaacttagtccattaaatgagaagtaaatgatgatgaccttagaaatggacttgtgttaatcctggatgtacatgctaattgtgggcttctgttttaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaccgtggagaagcacagtccttaataactactttaagggaagcagcatgacacagaacctgctggatgtcagtagctcttggcaactcagttttctttaaaagggaacttttgccctcctgtaccctaccttaaacatttcacatgttatttttttatttctgctgcctcagagaaatggcttctcaacttcagctcctggctttcctcccaagcctcagtgtcagagcttttatttctgtttcattcatgtccccttggccttcagcccctcttgccaagactattgcagtagcctccaaagtagcttttgtgctacaagctttctctactgttagtttgctaggatttttgcaatgaagtaccacagactatcttaaacaacagaaatttattgtctcaaaactctggaggccagaagtttgaaatcaaggtgccaggagggttggtgcctcttgagggctgtgagggaagggtctgttccaggcctcttcttggtctgttgatggtgctcttccccctttgtctcttcacatcatcgtccctctgtatatgctcgtgtccagctttcttgctttctttctttttctgttttttggagactgactcttgctctgtcacccaggctggagtgcagtggcacaatctcggctcactgcaacctccgcctcctgtgttcaagcaattctcctgcctcagcctcccgagtagctgggactacaggagtgagccaccacgtccagctaaactttgtatctttagtagagatggggtttcaccatgttggccagactggtctcgaactcctgacccaaagtaatctgcctgcctcggcctcctaaagtgccggaattacaggcgtgagctgtaataacagtcatattggattagagcccaccttaatgacctcattttaacttgattacctctgtaaatatcctatcctcaatatctccaaataagatcacattctgaggtactaggacttcattatatgaattttagggaggaacaccattcaactcataacacctactttcccccctgtgacacacctgatataggattgtgtagattctcaaacacatcgggttatattatctcctgctgaaaacacttggctggttctatctaaataaagccttcaaaccttcctaaggctgagtttccttccactttgttggagcaagtcaagagaaaaccaggagaacatgcctagtctcctttctctgagccttcacgctaaacctcgggcaaatagtgagagccagtcctggtccctcacctcccttccccacctcctcttttggcatctgtctcttaaaggcataacttttacagtctatctcgaagaggtcccttatctggtgtccttagagcatgctgcctgtacctgtatacttattcttccttgatactgttctcacttgaaggattagcagagtagacaagtttaagctcttgggggcaaggactcaggtcttcaacatgtagaacaaggctttatatatactaggcaccggaatacccattttaatggtattttttttcctgactaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtaaggcattttgtgtttcaaccacaagtagaacctacaacaagcaatataataagacacaagcttggatttttaagaattctgtcttagctaattctttgaatagatttgagaagatatctgctattgtatgccgggttatcatgtcatttctttagaactgactttaacccatttcaacattaaatgagtttataggagactaaagtgtcaacataccttacactaatttgtacctagtcccttaacagcactgagctagccaacttgcaggtaattaaatgaggccttaacatttttcctcaaaaggaggaggacagaaattatgcttaaggaaggccatggttacagaaacctcattgcctcagtgggtgacgctaccctaaaataacacttaggctgaatttgcatttagtcttctgttcttaacttttgattaagtggcaaattaaagtcatttgtgtgatcaaggagcttgtatggtgaggctgatgaggtttttattagcgtaattcatggtcaggcagggattagctcagtttaccaagaaattagttgcaagacagtctggtatgcctggtataccagagcatcttgagaacatttctcgtagtttccaggaacatgggatgttgtttagagggataaaatgtggttgtccatcattttgaattgtcaaattccaaacaccgactgtccttcccaaagtttcatgtatctcttttttgcatgaagattgctatttcaatgttgacacatcagctgtacaacttagttcagcagtggtttgtctattttacctggttttaaaataaccttttacatggcttgtctggacaaaacagctagccatgctggaaccctggcattaaccaggttcttggtttttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtagatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttccgcactgttaacctggcttatccccttttataataagtctctttaactagtgtactgttctgttccccctttgaaatgtgtgtaatgcttcatacagaggagatgcacaaatgcttaaatgctaagagttacaggacttgttgaggataaattaaaagcagttaagaattttcaaacctatggaaaaggacctctaaacgagacacgcaaattctaaggactttgctataaaaacctttgtcctaaatgaagagacccaagcttagctaacacgccaggaccacctgaatagctctccagaaccttctgcaattttaatttggtgagcctaaggtgggaccgaggaccctgcccttgcctggatggatgtggctagtccagctccagtgcacagagctacctctgggctgaacttgtttcaagctcctggcccatgtgtattccaacttctagttatcctagctccataaaacatggcatttttactaatgtcaattattatggattcctgaacgttattacctttcttgtatgttccaatactagacttagctcacttagctaccctctgatttttttcagtgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcagtaagtcagctttgtgtctttatacaccatggcttgaagtgagacttttcagaaaggagacctgggtgagagagagagagccattaggatgatggagttaccaaacacttcatctgctacctggctattagacagacagtatagcctgttagaacataagtcactcagttgatcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaagattcacttagccaaaattattatatgctttgctttaaaaaggtatcccaccgcccttagtatagctagcttttcttccagcaatagtcactcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttgtgtatctgactgacttatcttctaagcactctgagtgtttgaatgaccaactcaaaagcaaggtccatattaaagactagagttgccatcagtgagtgatcaccaagctcattctatacttcttcttttccacagatatcagttgtaagcacagatggatgatctagcttgacttctgtgacaaatgtttgcctttgaggtctaaacaaataatacccccgtcggaaatggtacccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 9006 - DNA, 210 bp, Homo sapiens; identical to SEQ ID NO: 9003

SEQ ID NO: 9007 - DNA, 3029 bp, Homo sapiens
acacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtagatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttccgcactgttaacctggcttatccccttttataataagtctctttaactagtgtactgttctgttccccctttgaaatgtgtgtaatgcttcatacagaggagatgcacaaatgcttaaatgctaagagttacaggacttgttgaggataaattaaaagcagttaagaattttcaaacctatggaaaaggacctctaaacgagacacgcaaattctaaggactttgctataaaaacctttgtcctaaatgaagagacccaagcttagctaacacgccaggaccacctgaatagctctccagaaccttctgcaattttaatttggtgagcctaaggtgggaccgaggaccctgcccttgcctggatggatgtggctagtccagctccagtgcacagagctacctctgggctgaacttgtttcaagctcctggcccatgtgtattccaacttctagttatcctagctccataaaacatggcatttttactaatgtcaattattatggattcctgaacgttattacctttcttgtatgttccaatactagacttagctcacttagctaccctctgatttttttcagtgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcagtaagtcagctttgtgtctttatacaccatggcttgaagtgagacttttcagaaaggagacctgggtgagagagagagagccattaggatgatggagttaccaaacacttcatctgctacctggctattagacagacagtatagcctgttagaacataagtcactcagttgatcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaagattcacttagccaaaattattatatgctttgctttaaaaaggtatcccaccgcccttagtatagctagcttttcttccagcaatagtcactcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaagcactctgagtgtttgaatgaccaactcaaaagcaaggtccattttaaagactagagttgccatcagtgagtgatcaccaagctcattctatacttcttcttttccacagatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 9008 - DNA, 14036 bp, Homo sapiens
ctgggaacaataacatgagagtttattatcacatgactactcaggaggggacatgaagcggagcaggatggggaaggggtgtaaggaatgggcaagtgctgctggagcagggctgtggccacggtcatggggccaggataactggggctgttgaagagcctcttttcctcagtctggttcttcttccagcagtcagatgcagggacgcccggtgcagaagcaccaggcactaataatcaggagaggcatggctagattccactcacttccaacatttccttctggtctcttttctaatggaagaggaaaggcaagacaatcgtgagtgggagagaaagggcggagtctctcctccaggggcagcttagctctggagctaccagaatcagcagcatggtacctgatccaaaggcatagcatggatatggacttccctggattcctgggctctttgacttgggggccacttggttggggataggggctttctgggctgggccaccactgggtagaaagacaggcatgataataggtgggacttgggtcatgggcccctttctcctccccaaactgtccactgtccattcctgtctcctttgagcagttccactgccccaaatacacaggcacacaccttagggactcacccctttggttgggaacattctccagcagtacagccacagaggggtcagagatgccagaagcagcagaatccagacacccaagagcatggcctgaagggttctgaacaaggcctggggacagagggccaaggccataagcaccaggatgacagctgccttcctgctctgtccccatgctccttattgacctgggaaaatctctacccctttatctccaagttcgtggcttctggaggggaagtcaatgcattcaatgtacagaatacagctggaaactgctcacattgggcctgtgtcctcatttgtacagtgacaggtttgggctatgatttgattccctgataacctccaagacttcagaggatcaagggaaaacatgcatttaacacctttgcagcacttggcacacttgctatagtggttcatttattattattttaatgcttgtatttcccacttgtctgtaacaccctacaggagccatttctattttgtctgatgctttgtctttggtgacaatacgcaagcttggtgcagaataggtaacacctatttctggtggagaacctgactcttgcccctggcctggcctggccatccctgccccacctgctgctgccccttccccttggccacctaccttcagcatgtccatgaaggaggtacataggtgtagccttctgacttcttctggactctgagtgggggctggagtgttccagtcactcgagctggagatgcggcaggcactgttgtaataagagtagccatatcggaaatcttcattccaaagtttgagggcagcgatggctgtggagaaagctgccagcgttagcagagtcctcagcagggcctggggagggaggaggcagagagaaatctttgtgtttcagtctctctcagagtccagtcgggggaaaaaagggcaaggcccagagaagcctgcaacagggcaggagattggggtgacctccagcctgaacctggtcccctcccatgcccttccctgaacttacccagtatgtaccaccccgtttctcgtaaatgaaggcagcagctccagccagcacagcctggggagagattgagccaggagcaggcttagtacaggaaatgcaactcctctcccacgagagagcctccatgcaggcccttccccagcacacagcttgggcgggaggtttcatgctaagctttattatccatggtaagataattgctgagagggtggagcctggatccaactcctgaggctgcaaaaggccctgctttagtgacacctaagagcttgtggtcaagccaggtgtgagcccctcttcccttctaaaccttcctttttaaacaacaccaagtgctttatgaaagttctagggatggtgggatcctgtggataaaagtcatggggtgctggagaagatctcaatgaagggtgagtctatacagagtgggcactgttaggtctagaagcctgtcctaacagtgcccaataatccactcagctgggcttgaagaacaggaaatctagtatgtcccagtggacaggtggacctgaatcctgtttggctaattctgtaattaagctgggtattttgccacaggctgggtgaaggtaattactctcggcttctgtcagtaaatatgagtgttttagtgctattctgagagtgtaggtaccatgaccagcctacccagctcctgtgcaaactgcacacacccatctgttgacaacaattcctgggtttccattgtgtacagggcctgtggaggacaatgagaataaccagggggtgatgcttcctgggggaccacatactatctggaacgctctgccttccccatctcaatgcaagtatctggagatgagcaggtccttagatccttagttgacattaactgttgaaggcagggagaggcagccagcctggtgggaacagcactgggaagggtatgggagagcagacagtgtgaataggacatgccaccaccgccctcagctgtttgctcatctgaacaggcagggaatggtcctagataatcagatctctccgactgccagcattctgtggcgccatgttggaggaaggcaatcaggagagcaatgccccacccctctcacaggcagtcaagcactgtcctgctctactcaccacagcccctgtccagatggcagctcccgaggtgacgaggagggtgtagtcgcggatgtagaaaaatcctcctaggactgcactcaagatccccagcacgatctgcatcacctgaaagacaaaggacccaagatcccggctcctaggtggacctgccactgcagggattaaccgctaaaaccccaaaaagagagggagaggtagagagagagagaaagaaagaagagaagagaagagaagagaagagaaaaggagaagaaagaggaggagaaggagaaagaagaagaggcaggaggaggagaaaagagaagggaaaggaaggagaggagagccggcccatcctgagtttggcccagaggaaaggatggactcagggctccactgattgggactctgcatggtcagtggctcctccacaccccttcagcccagagcctcccctccccaggctcttactgagaaggccagagaatcacatcgctaagtaagaagacataactggctcggtgtcctgttcagagggaggctggcagagagtgctgctgcggctggaggtggggagttcctcccgccgcccgacgaggcaggccgtcacactcacccacgaggccaccagcagccggctgctgcccctggcctgggtggcccggggccgcagcgcagagcagcaggtgagcaggagcttggccagggcagactcctggtggatgtgcacatcgatgtgggtgtgctgtggggcctccggggccatctcatcactgtcggctgttcccattgtcagggacacagtctatgaggaagggagcaccagagaggaacggctgtcagaagattttcgcagatttcattggagttggggaggtcaggggccagtggtggctcaaagtcacccaatgaatggctgtcctggtcacagggccgcacccctggcccctcacgaggggaatgtgtgtagcagagggggtgctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggtaggtcaaaagccggggccgcacctggcttcctctgcagtccccttcctggagtgtcatccctgggtgggggtccctcctacgctcctccaactgtgcggaggcagctcggggtgcgtgcggaaggaggcccgggggccgccgggagtggggtgccgcctcacctgcgctcctcgggacctgcgagcgggcggcgggagggctggggcgctggctggagaagtgggttgagagttggagggggaggcggggaggggaggcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggtgaggcagggcctccgcggcccgggagaccctcttgccgcaggaccctctgtcacgaggagtccccagggccatgcccccaccccgtcctgtccacaggacgtctttcttcctccaacctggtttccaggaggactcacgtaggagggagggacagctgggtgcaggtgtttctccccagaaaaacggctggagagcgggaggagaggcctggggctggcgcgtcccgtccaccttctgccgcctgcacgcctggaccctggctggagccctacggtggggtggctcctgggacggggccagggagcggcggggctgccggacgctttccccagccccggggcacgggaagagctggacagaggaaagtgttcggggcagccgggaagagcccaccacctaccaggcgtcgggcggcccgcaggggaatctccgtggtgccggcctggttcagatccgactcttcaggcgggggcgaggcagatctaggggttggcgtggggcgggggaagcggtggtcctgggggcccggaggtagctggaacccgaggtgccctcagggcgaggcctgggccgtcaagggaaggtctggctggaatctggggctgggctggaagcagtctgaagctcctttgtacgtgtgcggaattgtctaactcctgtcctttctaaccccaaggaggccaggtgggtgaaagagtgaaactgctttgaaaagtaggtagagtacgaatgggaggtgttattagaattgttaataatatttgatttaaactgtgatacttagccaggatgtccattagaattgcctatgcaggatttattttagagccaggcaagctgattctaaagtgcatgtgaagaagtagtctagcaaaaatggccatgacaattctgaaagaaaaaccacacgaggggatcatgaaacagcccaattagcattaagctccatgttaaaattgtggtaatgatgcctagcccatgagacatgccaatgggcagaatataaggactagaataggcctacattcctaggggaacttcatttctgctcaggagagaattttaaatcactgagaaaaagaggatgtattttccgcaaatggaacgtatctttcagaagttaaacatctgaatgacagcaacagaacttggatccgtgtctcccaacggcgaaggttggtcacccagctcccaaattccagatggtcggcatttaaaagtgaaaactgaaagcataaaggcacttagaagaaaatgtggaagattattttataatctcgaaacggggaagtcctttaaaagtgtaagagctagacaccataaatagaatgaaatagaacatggattgtatgaatatacaagcaaggtcaaaaaataaacttcaaattgtaaagaaacatttgaaactcatatcacaaacggtaattttgtgaatagataaagaacttccatagaaaaaagcaaaacaaaacaaaacgaaacaaggacataggatgtgaacggagagctcacaaaagaagaaataaaaatggccctgaacatatgaaaagacaaccaacctcactcataataagagaactatgggccaggcgtggtggctcacacctgtaattgcagcactttgggaggctgaggtgggaggattgcttgagtccaggagtttgagaccaccctgggcaacaaagcaacaccccatctctctctctaaaaaaagagaactggccgggcgcggtggctcacgcctgtaatctcagcactttgggaggccgaggcgggcggatcatgaggtcaggagatcgagaccatcctggctaacacggtgaaaccccgtctctactaaaaatacaaaaaattagctgggcttgatggcgggcgcctgtagttactcgggaggctgaggcaggagaatggcgtgaacccgggaggtggagctggcagtgagccgagatcgcgccaccctagcctgggcgacagagcgagactccatctcaaaaaatgaataaataaataaatacataataaaaaaatgaaataaaagaaaaccatggattaaaaatatatggaaatcattacagaaagcaggtcagtggttgctcatggccagtggttgggggtattttctggggaggggctttagggaatgtattgctgtgtaggaatgtcctttatcttgattgtagctgtaattgcacaaatgtgtaaatttgtcaaaactcgttgagatatacatttaaaatgggacatttttattacataaaattgattaaaatcaatgcatttttccccatataaaaggaaaaagataaaagagtttgcctcctgcatgtgaattgctaccacctccgtggaggataactgacaatatctactaaaattgcaaatgcgcattcctggtgccctgccaattccacattgtctgtaatggaaaaggattagaaataacctaaatgtctgccaatagggaaccacttaaataaattatgaggaattcatactctcaaaatatatgcagttacacaaatgagtgaagaagcttttgtgaaagttgtcagaatcataatcgagtcacttgagttaaaaaaaaaatctgaaaatggaaggcccacaaggcagggttctcatgcgtaaataacctgggaacaaaagtcatcacaaaggactctgtaaaatgacaaccttacacaaaaaaatacttctgtgaggacatccaccagcaactgcctgtctaaccctggacttgtgtcacccttgttattgatccttgtagccaaggatgatcacctcaaagagattatgtaagtctccccatttttcctttaaaaacctttgtcttcctttacctccctgaacgtgcacatgatttactatggtaagcatattctcattgcaatgccctattccagaatcaatctcattttcttttggagagcctctctctgttatttaggttgacactttttatggactcatgtaggattattctaaaaacatatgatcgtgtgatcacagcatcatgcaaatcagtgtgtatagtatgctgctatttgtgggaaaagggggcagaaatactttttcacacttttgtatgcaaaaatgtcatggtaggatttataagagactgataatattactttgcatctgcaaggcaaataggtggttgagggaaaaagatgagcgataaggttttaaaggtatatatacccttttgtatctcttaacttttttatgtgtaaaatcactattgatttccagtgccattgatatctgcactgggaagcccctttgaattttgacaaagacactgttttttgtttgtttgtttgtttgtttttgttttttttgagatggagtctcactctgttgcccaggctggagtgcagtggcaagatctgagctcactgcaacctcagcctcccaggttgaagtgattctcctgcctcagcctcctgagtagctgggactacaggtgcacaccaccgtgcggatttttgtatttttagtagagagggagttttgccacattggccaggctggtcttgaactcctgacctcaggtaatccacccacctcagcctcccaaagcactgggattacaggcgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtaagactggggtggtgcggggttggggggcacgttaacgaggtgatgaggtcaattaaaatatagagccaaatcttcaaaattaaaacgttttatttgggaggagagaattgcaatttggggcatacacacagaccaggtggtctccagtatgtctttagaacaaagagaaggttagaggcttataaaaaggagaaatgttacatattgcccttcatgaaagatcataggttttggggagctggtgagctctgatgggtgagcgatggcatgagtaaaactaatcctagagttgtagcaaggtcagaagctgtagataaagctggtttcaggttgcagcaggcagcttcagcagcctgatttgtagagaattacattttgggagcaacattttgtgccccgagtgctttttgcccctggcctctcgactctgttttagttgagtgtgacaagaatgaccccatttgtaggctcagctttcacagtggaaactctccttcttcaataggatgcaaaagaggaaagtgggttgaattcccatgagagggacatgagaaatcactatttatatctcattctgtgtaggaaaaagttgtaagtgtccccacagaaatttggatggaaaggaagaatcgacctcctctttggcacagaggagtcggtcccagccagaggtagggcaacaggaagaacagtctagaggctgttaattcggttttattgaccccacatggactgaaagcctacaggtgcaaggcaatgtgttcagcacttcaggccaagctacagagagaatccctgggctatatctaaaagtactcagtgaccatcagaaggaacagcagctacactaatgactggaactaaaggtagatcaggtgagggagaagcacatctgacatccttgagggcaggagaaccctgaatggagaaggaataggtatagacagaggtggaagatggacaaaaaagaattccaggttaaagaatggcaggagcaaaggcaaagaggccagaaggcatagggcaagttctataatggttaagagtaaagggaatgggcttcatgaatgggtgatttgggcccatattgctgagagccttgaacgaccaggtgaggagtctgtcctgaatcagctttgacagtgagaacgctgtcaatggattctgagcaggaacctgcctcagagtcaggaggcatccaggtgagaaggatcgaggatctgcactcacataatcatagcagaaatggtgaggagacaaaggagtccctgtccttcacagacctccatggcatgggagtgaaggggtttggggcataaggaaagagaggcattcacagcatgcagagagggttgaagtgtgggtgaccaggagatcggagccctgaaagtcaggaggagcagccattcgagaggtgtgtgtgtgtgtgtgtgtgtgtgtgtgtgtgtgtgtgtggtagtaggggatttggatgtgacaaatccgagatgctggtaggatgtggaggtggtgacagttgggttttccaggaagaagaggagttctcttctgagtcggagttgggtgtgtgaacggcttattggggtatgacacctatgaaatgaaaagagggggagcaggattgagcaggaggaaccatcaggctgcaatgcagactctgccaggccagtgggggagctcccaggcaaaggttgcccactgcaggagttccacactgggtggagatggcccttgagccactgtcttgcttaatcattggctggggggccctcctcagtgtgtgtcttcagcttgaaaaattagggtgaccctgaaggagctgacaactgcaggctgtcagcaatcaaacaagccctttcttgaaggaggtctcagcggcacttctttgtgtctgccacagagccctcaagagtgtgtgtttggatctgaagagaaaggataggccagaagctcaggtcaggctgggggtttggatgggacaatgggacctctgaaggagaatggggggggaaaagtgggaatcttcaggtgggatgagaaagtgttgaagttgggaaaaattgatgaaggataaatagccaagcctatgagaagggtgaggggagacccaggccagtgctgcttcatggattttaaggggacagaatcttccagaatcagagctgcagagaggtcaaggcagaggaaaaggagaggagagccacctaggtaggagccaggcagctggtcccagggcagccggggcatgtggactcacgggaaggggtctggtttctcatcctgtcttgcaggtgactcagatattgctgggggttgtgagttgtgttcttggagtgtgtctcagcttggggccctggactgtgctgagtgcctcaggctgtgccttctgggcggggtctgtggtgagtaaggaacaggctgtgagcctggagggaggcaagtggtgatgggcaagaaggcgcttatggatcttggttggggctttggggaagcgaccaaagtctctggagccaaatggcctttggccatgaggaggctgctctggggtgtagctaaaaccctgtcacttccatttttctcttgaagacagatgggaggggtggggcaggtataggtggaatcctggtctgtgtgtcagagttctttgtctgtccctgggatcctgcttcacattggctattctgggaactgctggtgggagggtgatgatagaccaattcagaagagtaaactggaggcctttttctggtgtctcttttcaggtgatcgcagcaggagctggggccattgtccatgagaagcacccgggcaaacttgctgtgagtcttggacaccctctctccaccttgttcactgaccccctcctgaattctgctccattatctgtcttctgccctttggttgtcaatatcttggggtctttcttggaggggaggagagggtttcctggacaagggctggggaagaggagagggatttgaggcggggacctcatgactcttccaccgattgaaggagcgtgtgtcatgaccctctttctcttccagggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgagggtgagcaggaagagtccagtcttcggggacccatcacagctcttttttcccagggagctgggggccctggaggacagagatgtaggctctttgagcttggacttcatgctgggtctttcattcaggaggttttaatgtaagctacagacatttttcagacctcatgacacgaagattctctgaatcaaggagggtgaggaacaaagaggagacatttcagagaggagatagtgggtcacccttctggcttttctggtgtgttggtatcacagttttccattactgaattaaaaaccacaccaaaatgtagtggcttaaaatgacaacttattatttctcacggtgctgtgagttggctggattcagatgagccattctcactcacgggttttctcatgcagttacagtcagatgggggtgaagttatccaagtgctcgccgaggctggaggtctgagatgatgtagttgcatggtccggagctcagcgggggctgtcagcaagagccggcaatggcttctccacttggcttgggcttctcatagcacagaaactggattccaatggggagtaccctagttgcaagcatttcaggagacagaaagtagaagctgccagaccagctaagggcttccctgtcactgtatagtgtcactttcactgtggccaaagcagttctaggcccttccagattctacgggttgaaggaatagtctccacttcttgacagggagtgataagttcactctgcagacaagccaacgggatggaagctgtggctggaaacacagtcagctgtggtgggagcagcaagctggatagagtcagtgcctgggtgggtggagagggtggtgatgtgggcagcattggagtagctgacacctgactatctttgttcttcccttatctccagaagttgttcacagcaatccgtgccctgttcctggctgtctgtgtcttgaaggtcattgtgtccttggtttccttgggagtaggtcttcgaaacttgtgtggccagagctcccagcccctggtgagttgtcggggaggggcctctgggcagcgtgagtctgggtggtgagtgtgtgggacaggtaggagtgcggggccaggggcacccgaacctgaggctgggcctggtgcccctcagcttctttccatatgcagctctcccctttgctgtctggggaatgtggccatcaccatggtcctgggccaactgtcgccgccctgtgcctctctgcgccctcctctgctctgatctccccactctcccctctgccctgtcccaggtgttcgtctgactccccttcctctgccaccttgttttttttttgcctgatctgcttttcctgtcaccttttcctttccctcctcctttcctctttctgctttctgagttctatgatactaactctgcctgcatccttttcccctaaggatttcttttttcttttttttccagaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaagatatggtttccctttgtttatacacctcgtgcgccatgaaaggcctttctttgtgtcgctatgtatgaggttaaatgggagctgatttatcccattaaaacactgtcccaagaagattaaatttaattatgttctgctgtacatccaggtggcaaaacccctttttatgattttcttcaattcagtgtaaagtgtaagtcta

SEQ ID NO: 9009 - DNA, 481 bp, Homo sapiens
ctggttcaaatggactattttatccatttatatttattgcagttactcataaacttaatttataatcatcatcttttttttgctttctatttatttgtctcactttaaaaaatatagtcatgctgatcatttaagggtttagttgaaggtaaatttctccagcagaatttgcatttgtttctgacaggtgtcaggggtcactaccatcttgagaacctttaaattattttctcagggtttgggggtttatccaaggagtgggaattccatccataagtccatgttagggccggcttgtattcacgaatcttcatctgactcctttcaccaagagtttacttgtcatctccctcaaaggagtggattttttcccaaatgtcctctgaaagtgaagatttatactgggtccttcactgtaactctccagcttaagtggctctaggcttcatttactgtctttcacatagttattaagtgcagt

SEQ ID NO: 9010 - DNA, 488 bp, Homo sapiens
tccttcctttcattgtaaatgatagcaaactgattttgactttttccattttctttatatatgaagatataacataaatatatagatgtaagcatttctgaagggcaggaaagctggtaggggctttatgaaatctccatgaggccagtttcatgacttagcagccccacagggctggtcttcagatccaaggcgatgggctgcagggcctgcaccttccctcttggcagagcggtgccacagaggtgcagagctgctgcgctgggcaagacctgctcctgcacaggacttggagtaggggcctgtgccgagggcggtgctgctcttcctggggccctcaccagcctgtgctttacatagaggcttgtaaagaagcctgcgagacaggagtgtgttcagaatatggacagggtcagccgattacagcctgaggggtaaatccagcctgccattgaattttgtaaataaaaatgtatctaaacacaacc

SEQ ID NO: 9011 - DNA, 9914 bp, Homo sapiens
cgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaaggtgagcaggggcgggccgggatcgcggggcgagtccttgtcctccgactttgccggttcctgggctctagcctccgggactcgccccttcaggcctcaccgccagtctccccctgtctcggtcctcatcaccatgcccgccccccggaggaccgacctccagcaccgtctcttgctctccgtgttccacacctttgtctgcagaccccatcttcgtcatcactgtaatcccttccctacccgaatttgttcccttccctgtcgccaccagactggttaaggccccaaatccattcgctagcaaatccatgctcgctctccaagggtaaagatttttcgtctccccctcccatttcacatacacacctacgtctgctttaggcctaagccccactgaaaaacgtttttctctcacctacatcacgacaattggactttatccacaaacccctataagccctataaacgtcctgccctcttgagatttggaatttcttctgctttttcatctgtatcttaatcttgactgccattcccagctcatgggggtaccagggtgtcttctgcctttggagagaagtgtttgtttttctctaggggagagaaattttgcagaccaattaagtataaacatccattcctgaaagacattcctagtctccgtgtcttcctcattttctcgagaggaacacaggaaatttgcatatctcctgctgttttgcaaagcacacacactgatatgtattaatttcgtttaaccctcacaaggatcccatgacgtaggacctgttattggcccgttatctagataagattgaggtttcatgcagagaatcgcagagctgttgcgtcatgcaattgagataggaatctatatttttttttttattctgtgatgttttggaactagagccttcgggtagataatctccaaatcatgtacagttgcttctagaatcttttcatgtttatacttggaatttcagttttggaaatactcaacaaataatgaagtactcttcagataatgaagcctctggtgatggccagactgaggtatatggttccatagcctgcttccccactccaatctaaaactgttccccccaccctaggtatacatagcaccacctcacagacagaagcaaaatgccaacctaaccttaacctcccactttctggggttcactgcttccctgggtgtgggtttcgtggatatgtgagcgttagagacgtaagggacctttgaagtcctcaatctaactcttgttactttacagtgaggaaactgacgcctagaggacctgtgacatgattaaactcagccagcctggatgtaatagagccaagattccactccaagtctttagactcccaagtccaatattaccatcagttctttggtctctctccttgagtttagtcgtatttgggcatgcagggacataaaaatacttaagagataaccacttctaaaatttttttagagatagggtcttcgtcttacccaggctggagtgcagagatgcaatcatagctcactgcagcgttcaactcctggaatcaagcgagcctcctgcctcagcctcccaagtagctgggactacaagtacacatcatcacacctgactaatttttaaattttttttaaagacgggggtctcactatgttacctaggctggtcttgaactcctgggctcaagtgatccttccacctaagcctcccaaaatgctgggattacaggtgtgagccaccatgcctggcgataactgcttttagaaaaataaaaggccaggaatgatggttcgtatgtgtagtttcagcactttgggaattcaaggcaggaggatcactggaggccaggagttcaaggctagcctgggcaacgtagcaagactttgtctctacaaataaaaatttaaaaaaaggaaaaggaggattctttgatgtcttattacatataaagcatcagtttacctgtgagatcggataagcactttctgaggagacttataatttctataatctttattgttaatgatagtgttataattcttacagctgcaaaataattcatggtcccttttttcttcctctgaacagccactatggaaggaggggtcaggattacagcagaggagactggcacacagagtgttaagtgacacccactcaatccaccccgaagctgttacacttaattaaccctcaaactgcccagtgaggtaggtcagtatgaaaacctgaaaaaggattataaagcactttacaaattcagagactgccctctaccgaaaagtattatttttttccctctggaagtcagttaccgctaagagttgcaccaggcctggggaagtgtagggattagatattcatgcctctcctttgaggctctgggtccttcattgttgaacgcactgcttgtattgcctcctgctgcgactcactggctctcacttctctgtcacggaggggggctctctgcctttcctaggcggcttataacctggcttccctcctgggagcaacccgccgccaggcctctaacccgactccctctgcagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctgtatccttcctagcagagagctatagaacaacgcatgtcaaagggtgaaccaggctggagggtctggggtgtcaagtagataaaattgggcttactttgtattttttcgaaacagagtctctgtcacccaggctggagtgcagtggcaggatctcaactcactgcaacctctgcctcctgggctcaagcaatcctgcctcagccccctgagtagctgggactacaggtgtgcaccactacacccggctaatttttatattttctttttagtagacacagggtttcaccatgttgcccaggctggtcttgaactcctggtctcaggtgatctacccaccgtggcctcccaaagtgctaggattacaggtgtgagccaccgtggccgagtcatatctgatcataatttttttttactttttttttcatatctggtaattttttattttatgctagacactgaatgctgtattaggggctctagattttgttgttttcctttaaaaaatgttgacttttgttctgataggcggttaacttacttgaagattggcttgaaacttgaggtttgtttctaagctcttttcgggagagtctagcatagcctttattcaaaggctgaatctttgtggctgcctaatcagtggtgggtgacttaggtcagacgaccaggataccaccaagttgctggggatggtgacagggtatggaggaagcacagccagagaggcccacatgaagctcacatggtcgcactgaggcaggtgccctctatttgagataaaaggacgaggtgttagtccctcaggatgatactggtacagcctcctgccttatcctgctacaccagcagaggcatgtcctggcttctgactgactgcagtggctagaagggtgcaagtggtggcacacatgggtgtaggagaagggacagcattaataccccctgctgctgggcgcattcattcccggtgaggcacagtgagtagaaacctttggctctggggtcaggcgcagtggctcacgcctgtaatactagcactttgggaggctgaggcaggcagatcacgaggtcaggagtttaagaccagcctagccaatatggtgaaacactgtctctactgaaaatacaaaaattagctgggtgtggtgacgggcacctgtagtcccagctactctggaggctgaggcaggagaatggtgtgatctgggaggcggagcttgcagtgagccaagatcacaccactgcactccagcctgggctgctagagtgagactccatctcaaaaaaaaaaacaaacctttggctctgggtttcccctgagctgcaaactccagccagagtgtgcagcgtgctaagcatgaaggcttctgtagagtgagtgggaacctgtgttctccccggggagtgttcggccctcctccctttgctgcctccagtttcacttaacacgccaacctcagatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaagtaagtgacagaactcttaagtgctgttaaatcttttttaaaaaaaaaattattttttttttttgagacggagtctcactctgtcacccaggctgtagtgcagtggcacaatctcggctcactgcaacctctgcttcaggttcaagtgattcttctgcctcagtctcctcagtgtctgggattacaggtgcccaccactacatccagctaatttttttgtatttttagtagagatggggtttcaccatgttggccaggctggtctcgaactcctgaccttgtgatttacctgcctcggcctcccaaagtgctgggattacaggcgtgagccactgcccccggccaaatgctgtcaaatcttattctgtttttttattcttttttttatttgaggacagggtcttgccctgttgcccaggctggattgcagtggtatgatcatagcccgctacagcctcacactcgtggactcaagtgatcctcccacctcagcctcccaagtaactgagactacaggcacataccatcatgcctagctaacttaaattttttgtagggacagggtctccactgtgttaccaaggctggtctcaaactcctggtctcaatccatccttccttgatttctcaaagtactgggattacaggtgtgagccactgagcctggcctaaccttattattaaagcaactccagggcatgcagagggtgtggctggtttattgccgtaagtgataaagaaatgaggtgcggcagattggaaaataatgcacagatgtcttctgagcattctggattctgcacaactgcttctgaagtagcaacagcaggaaagggaaggcatttgaggacacttaacatgtgatcctgagtgacttgtagataggctgggcaggagggcccccatctaattgacattagacacatacctgctgcaggtcagcctgggctgtgacacacaatagcctcgataagtgcagatagggctgggtgcgatggctcacgcctgtaatcccagcactttgggaggccaaggtgggcagatcatataaggtcaggaatttgagacgagcctggccaacgtgatgaaaccccatctctgctaaaaatacaaaaattatccaagcgtggtggtggttgcctgtaatcccagctactcaggaggctgaggcaggagaatcactcgaacctgggaggtggaggttgcagtgcaccgagatcacaccacagcactccagcctggttgacagagcaagacactgtctcccaagaaaaaaaaaaaaaaaaaggtgcagacagtccacacagccaactaggctgcttaggaggtggcccagcccaggttttctggtgaggtttactgttttccagttggctgattaactcacagatggaaagtgctggtaagccgccagagcttgtgtggcctggctgcttcattttatagaggaggcccaaagaagacaagggtctttctcacccactctgtttccaggtaacagagtcaggagaggggccatctggaagcacgtcccctgcttaggaggccacctccctccctctcccctgttcccagtgcctcctgcctctgagttctccgctggtttctgtccatgctgagacctcacagtgtaggattttttctttccttcagtggtcctccccccaaaaaaggagctcgctgggaaaggcgtgttcatccattttgtattgctataaagaaatacctgagcctgggtcatttataagaaaagaggtttatttggctcatggcttcgtaggctacactaggatcatggcaccggcctcaggcagcttccaatcatagggcaaggggaggcggcaccacacattgagagagggagggaggtgctgggctcttaaacacccagctcttacctaaactcagagggagaactcattactacggggaagaagccaagccactcacgcaaggtctgcccccgtgacccagacgcctcccactgagctccacctctagtgctggaacactgggaatcacgtttctttttttttgaaatggagtctcactctgtggcccaggctggagtgcagtggcgtgatctcagctcactgcaacctccacctcctgggttcaagtgattctcctgtctcagcctcccaagtacttggaattataggcgcgtgccactatacccggctaaagatccatttcagcacatgatttggagcagaggaaacatccaaagtgtatcagaaggcaaggtgcttggtccttggccctttttggcccgccaccagctgtggagtaaattttcccctgcacgctggcctggatgtggggtttttgttgaataggaagctgcccttagagcttcttccaagaggtgctcccagctgtcaacagctcagagcccttggactatttttctaaaaggccaggagggctgctgggaaaacagaaatgcggactcaccgcattattgcttcaggcaagtaattcctggggtctcaatgtgggggagactgtacatttaggactaggtgttttgtgggttttagttgttctcattgaatctggagaactgtctgtcaccaaggaatcccctctgtaatagctgatggtggtctccagctgtatctcacatacaagagctcactctccaagactggccctgatgagaaagttcttccatgctgaagggccgggcgcggtggctcacacctgtaatcccagcactttgggaggctgatgcgggtggatcacgagatcaggagatcgagaccatcctggctaacacggtgaaaccccatctctactaaaaatacaaaaaattggccatgtgcggtggtgggcacctgtagtcccagctactcgggaggctgagccaggagaatggtgtgaacctgggaggtggagcttgcagtgagccgagatcgcgccactgcactccagcctgggcaaaagagcgagactccgtctcaaaaaaaaaaaaaaagagttcttccatgctgaattgcaatcagcctcacagacactgccacacccagtgccaggtctgatcctgcctcactgtgacaggcagatcttagggtttaagaggaagatggtgttccttctgtgttccccacgtgacatggagtccagtccctcaggtctggtgcctgctgcagacactcagaatattgtgtttcaggcagcctgacagtgggtccagggccatgtcatgacacgcatgtttattttgtcagcaagatggccgtttggacagcttgtctcctcagaggctcttgttgatagataattttttttttttttttttttttacacatggtcttgctctgttgcctaggctggagtgcagtggcacagtcataactcactgcagcctcaaacttctgggtttaagcagtcctcctacctcagcctcttaagtacctgggactagaagcatatgccaccagacctggctaattaaaaaaaaaaaaaaacaatttttttttttgagacagagtcttgctctgtcacccaggctggagtgcagtggcacaatcttggctcactgcaacctctgcctcccaggttcaagcgattctcctgcctcagccttctgagtagctgggactacaggcgcctgccaccacacctggctaattttttttttttaatttttagtagagaccgggtttcatcatgttggccaggctagtctcgaactcctgacctcagatgatccacccgccttggcctcccaaagtgctgggattgcaggtgtgagccaccatgcccagcctgaatccgttctctttgggcagaattgtcgagccagccacacaggcactggcagctgtgacctggtcccaacgctccatctggtttagaagctgctgtgagcaggtcacccctccggtggtctcagtggcaggtccagtgtcctttcatacaactcccttgctgcaggactgcaactggccccaccctccctgggcatctgtggtctgattggttgaggttaacctttctcccacttggtacttagagcaagtcacagaaaacatccaaggcatgttgtactagaaagcgggggcaacctcaagcacaagatgccatgaccttgccaagactcgctgaaggaccattttctctcttgttccattccagactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctgacctgcc

SEQ ID NO: 9012 - DNA, 1290 bp, Homo sapiens
gccagagcccagaagctgggactacagttaggagggctgctggcagggctgtgccaagaaggacatgggcactgctggcgatgtccctgaagcaagacgggagaagacgctggctttaccaccagtgtctcctgttggccatgttgaccaggaaccaggagtgaggggcggggggcctctatgagacagtgcagggcactgatgagtgtggctgagctgtcactcacctggccagcccttgaggacagctggggctcctcacggcaggctgtgttgagaaggcatgccagctgcctggtgttttgtggacctagtaacacgtggccttcatttatcccaggagctggatggcccattctagactggctttctgataggttttaggtctttggacatgtataagacagaaccccaagcccatccagcctggtgagggtggggccgtgacgggcccacgcctgggggggcctcagacatgagcaagaaggggcctgcgctggggtgagagggtgtgccactgtgtgtggccctggtttttaaatctctttgttccttgggacttttccttagtctggccacaatgcacaacacagcctggagtcagctcacagtgggaccctttctcaccctcacgtgcattttggaagctctggaggccatcccaaccccttctcccatttgcctgtcaaatcatccactaatatgcccatgtccggaaaccattcactgattctgtgccaagccggaggctcaatgatgatgagccccatgtgcgcagggagcccctagcatggggcctggcactcaataaatatgagtggaatgaacggatgaataggtgatgcccgcccttggggagctcattggagcagaagaaatggaaaataattatcattcaggccgggctcagtgactcacgcctgtcattccagcactttgggaggtctgggtgggcggatcgcttgaggtcaggagttcaagaccagcctggccaacatggtgaaatcccatctctactaaaaatgcaaaaattggccgggcgcagtggctcacatctgtaatcctagcactttgggaggccaaggctggtggattacgaggtcaggaattcaagaccagcctggctaagatggtgaaaccctgtctctatttacaaaaattagccgggcgtggtggtgggcgcctgtaatcacagctatccgggaggctgaggcagggaggcggaggttgcagtgagccgagatcatgccactgcactccagcctgagtgacagagtgagactccatctc

SEQ ID NO: 9013 - DNA, 11597 bp, Homo sapiens; identical to SEQ ID NO: 7266

SEQ ID NO: 9014 - DNA, 22073 bp, Homo sapiens; identical to SEQ ID NO: 7267

SEQ ID NO: 9015 - DNA, 1346 bp, Homo sapiens; identical to SEQ ID NO: 7268

SEQ ID NO: 9016 - DNA, 13236 bp, Homo sapiens
gcggccgcctcttgcgcgcgccccaccgaccaaaatggcggctgccgttggtgcggggtgcggtttgtagtgctgttgccctactcatccctttgcaaaatgtgaaagaagaagcggctggtggaggcgggccatagcaatgagtcggcgaaggaaacatgatgacagccctagcccgaagaaaacgccgcacaaaacagtggcggcggaggaatgcggctcggtggtcgagccagggaggaggcggctgagatcggcccgcggttcgtggccctgcggggctagagaggggcctcccgggccagtgcggcagcgagagcagcctccgaccgccgccctgtgcagtaaaagtaaccccgagggtgagacgtcggcagcgcggcctgccttggcttcggcgccgcatccccacatcccagcttgcaacagggaaatctggggtgggggtggagtctggagcgtgtattctgtctctgggattcacccctcgagagtccaaaaataatcctataccactccccgatgggcttttgtccccgaacttcagcactaccccgttaggtttgaccatccatttgcctccgccacaggaataggtaatgtggtttacctgtttgcgggagggcggctgctttccaggctgctcctccagtcagcagcagtggtggagtgagaagaaacagctgataggcccgctaacctcagtttttgcccggagaagttatttctctttaaaccctttttttccctgtgacctgctttagagaagagttcataggaaaagttaaagtttgtctcaaagcctggtagatgtctcacctcattgtgaataaaccggaagttcctgtgtgtaacatccctccaaataagatactaaggatctctttcgtctcgattagttttaggtgttactttttaaaagacttctagtaaatcttagttggaactgaaactcatacaaaagcctttattctggagcatgttcttgaaatagtgcttttttttttttttttttttttataccttacgtgtcttttttcttttgggaaagaatctcgccctgtcgcccaggctgcagtgcagtagcacaatctcggctcactgcaacctccgcctcccgggttcaagcgattctcctgcctcagcctcccaagtagctgggactacaggcgtgtgccacctcgcccggctaattttttgtatttttggtagagacaggggtttcaccgtgttagccaggatggtctcgatttcctgacctcgtgatccacccgcctcggcctcccaaagtgctgggattacagccaccgcgcccggccaccttacatgtctttaataatactcctataaagcaatttgggaatgaacaaaaatctttataaaaatttgaaagtgattctagacaaaaattcccaagcattggatcactaatggtttttgaagaatggcaattaatgtagattagatagagttggtgaaagggggctaaacatatttaggtttctgttgggttactttggatttttgaatgtacctataaattacagatggttccccaaagcctccaagactcaatggtaataaatagaatgacttaggttatacagtattgtattatgcattcataaagcttctggattatctagaagtgtttgctatttacaatgtgaagtttgcgaagtgccgcgtggatttttatgtgaaacaagcatttctgttacggttcaggtaattatctctgggaaaaaaaattatcttggactataaaagttagtctcagctatttgaccttggggtcttacgaagtaaggtaatgctttaaaatgcaacaattgttattttactcatattttatatagaaaggtatgaaacaccaaagagagcgctgaaaatggactcactgtcatcttccttcagttctcctaatgatccagatggacagaatgatatcttttgggatcagaattctccattgacaaagcagttaggtaattaattattaacattttttatgtgagtaaatatttgataaatgattcagatttaactagaattctagtcagataatagcatcgggaacctctgagaatgttatatgattttatctgtataagtatgtgatgtaaacacataatcctctaagctgcactaaataaaattactttctaagaagtgacagctgttttttaaaatggagggttttttgtttaaaatttatagaaatgtctttgtttctttaggtaaaggaagaaaaaaacagatttacaccacagatagtgatgagatttcacatattgttaatcgtattgctcctcaggtaaatatcactagttttacagtttgttttaaaacagtgaagaatgtgccactaagtttttgtagtttctttaaatgaaaagtattgtctattataattcttttttccaaaaataaggcagcaaagattactgttttgccttttctacttttgaaatacatattttgaaaaaaggaatataatataaaatacaagatattttcttaagtatatatcttgttttaattttttagagtaatttttgactagggcattgtgtttatctgtaatgttgtgcttaacaacatacgacatcatttttcaagttgctaaaataatagaataaggcagtgaaaaaagtttatacttctatgattgttttgtgattggtacttcctgtctgtaacatttccccattgaaactattaatactcatttccttataagattatcaagaaacacttacaaaagtggagagcactgaattcaaatttagtcctcattcaacctcctatgctgtgtgacccagtgcaagttatttaaactcccaccacttcagttcattcagccatgaactagaattattgtgttgctcttgctgtcttcattggatcattatgagaattaaactagataaaaattctttgtaaactatagagtgctataattgtaaggttacgttaaggttgttactgtaatagaaccatctccaaagcttttttttcttttcttggacaggcatggtgactcattcctgtaatctcagcattttgggaggaaggctgaggcaggaagattgcttgaggccaggagtttaagaccctgtctcttaaaaaaaatttttttttgagtgtttcgtttctttttttcatttctgttcttttattgtttgagtgaaatagaaatatgttcaagtcaatcatttgacacaaagcaatccagtaactctaatattataattactaagaagcaaaggctcaatacgtgaaactgttctgaacttctttactttttgttctctttttcttatttaacatttaaatccagagaacatttttgcttagtgtcttctctgaaggaagtatgccatttttccttaacctgcgcttgaatagttactatatgttgaccataaacaatagatggcactggcccaaaacatggtttgaagaattactgtcacccaggtggaagagacagaaaatgaagtttttcttagcagctataaaatatccaaaattacacctagcacagtcaaaacaactctgttgctactagctctacattccatttttagcatgtcatagaaattcattttacttacagttaattagttaaatagcatttatgccataatagtacttactctataagttaacaatagatcttcattaattgtgggtttcacatgaaagaagcataataaaatgtgtttgggtgggccagtctaaatagtgataaaaagatagttgtgaataaattattggactctttacctaagtgggctagaaataatagctcatataaagaaatgacaacagtacgcaagtggtaacttgtataaaagaaaaaaatatagtgaaattagtagctttaaaatgttaccctcttaaactgagtacttttaaagcatataaatctttagcagtttcaaggtctgtttgaaagcttgtcatgttctcagaatgacaaatacttatattgtttatttttaggtgagtcattctcaaatcatttagttttaacattttcagagatagcatttttttaaatatgcgcttttattttggttggacagtcagttcactttttgcagggatacttttatacaatgttgtttatttgaagatggtatgtatcttcatttatacagctttgcacagtatactttttataatgaaatgaagtaatgcatttagataccttatacagcacctggattatggttgaaaatcaataaattatgtaattattcatgaagaaatatgtaataacatgtataaatagtatacaaacatacataggacccatgtatatgtaaagttgggtacataaagtcataatttagttctctgaaaattgaatgaatttaaaattacttttgtaaatggcagagttcataattaagactatgattgtctttaaattcaagattgttgaaataaaagggaaaatatattgagtctgaaagtgaaattactgattttcttgagtatttgcaaagctaaaggcaactaggttcaagttgacattaagaaaacttttttgattcattgaggatttgaagtaccaaactgtagggatcttttcacctaaatcttctagtaaataaatgtatactgacactggtatgcccaatattgtgctggatgctgagttattctaagaagagtccttgcctttgagtagcctataatctagtagtaaaattattttttaaattgtgtgatatttatgttcattctaggtactataaaatagagtgaaaatggttacttgatttgatttgttggtttggtttgcaattaatgcctaaagctcattctgtaatttttttgtgtgatcaagtgactgaaaggtacagcaaaagtatccaggtctaaaatgccttttttctgtatattatctgggctaaacttttctgttttctctatttttttattcttattcctgtctcattcttagcatcagttctaaccttgctcttatctcttaattcattcctgatcttaattctgagtgttcttaatttaggtcaacatggattgtccaactttagataaagattataataaggataaagaaaatttggagaaacagatgatacagaaagaattccatatgtatctcctctcaattctgatgatttctgccacacagtttctgacactaatgtttttataagtatcttaggacaattaaaatgtcaattttcttttgataaaaacatgcttctgttattaaatgtacatttgataaatttaattcttaaaacaatatttttttaaaataagcaatttgtaattctgaatgttttcattctctgaaacataagtggatcaattattgtagcttattattgctatctcccaacttcctattgtttttgagtttggtaagtgttacctcaccagaatttaggaaattaattcaaaatcattagtttttattgtcttttttctttcttttgtttttttggaagacgggggatgctacactggtactttatacctctttttttccctatctgccaaaggatgaaaaaccaacaacaaattctatgctggacatgtggattggtgaaactgctattccttgtactcccagtgtagcaaaaggaaaatcaagagcaaaaatcagctgcacaaagtaagttaagacttttcagcttttctgaaattcagtgaagcaaatattttttgataatactccattttggttttgtgaatatatcaaaatttttgttaataaaatttccacagttttgatctatcaaattttggagttaaaataattataactgttaaaatcttagagctttaacatcaaaatatgttaaataacagttggatataatgtttcagaacatttttagttattttttaatcttgtttaataggttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgtagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaaggtatgtatgaaatatgaaatagttttctttgaaaagcatcttaaaaagtagtaaaataattatttgttgtttttgagtgtgagtaatgtataaggtaaaactattctatgactagttaattttaagaattaactagaattcttaaaatgatacttggaaataattatacggcattatacagagtagttggtttatttttcaaaatattacattgaattctttcccagcacttaatacaatgactggcatatagtaggtactcagtaaatattttttgaataacttattctttcttggaaaatcatacctttagatatatgtattatagtgttcattaagattgtatttactaaattgttttaaaacttgagtaatctgggaagcagatgatgaagcagtgaggtaaataatatttagaaatttagagcattctaattaaacgtctttactagtgtgatatttgatataaacgtgctagcggtgatggttaaaattatgatttacttatttgataacagctatcatttctgattcttccaatttctcttttccccaagtctccattctatcaataagtttcattctttcaaaaaccgtatccccagactccatttttctttctacaacaagttaacatttcttgatgagactactgcagttcttttatctatctcctttcaattcttatctccaaacagtggaatagccttttaaaattggatgggcaaaaatggcgtttctatgcttaaaacaaccttcaatggctgcccgtcatatttcaaataaaatccaaactgtatactgtgaccaacaaagctgtggattatctctctttaacctgcgtctcctcttttttccttacctactaagcttcagctataccagctatcttttagtttttcaaacagtgtatgtttttcttccttgtccaggaacttagaccgtgctcttccctttgactaaaactacttcttttcaacatgtgaccccttccccactcttttgttggtgctttcttacatctcagtataagtactactttctcacagaggccttccttgaagagtctataaatagatctccttgtttattttttatttcctaattgctttcatcacaagttgaaattaaatatttagtgactcttctctgtcttgttggcattactgttccaactttcctatctaagtgactttttttaaaaatttacaatagtaatatgctagttatttaaaaagaaaagtaaaacagtatagaataatttaaaggaaaaagttaagtcttctgtttctcctttctgataaccatcccttacggaaaaccactattaatagttggtatgatgtagcattttctatgaatataaaaagatatgtgtgtgtgtatgtacgtatatatgtgtatgcatatatatatacctatagatctatttaaatattaataaatctgtatacccactatttggcaacttgcttttgccttaatatattatagctgtcttttcctattagtacatataaatttattttagtcctgttaatgactatgtgatatatatggtggatgtatcataatttaactgtttctctgtgatggaagtttgggttggttgcagtcttttgcaattacaaacaatactccagtaaatatccttctgcataaatttccgcatgcttgtataattgtatctgttaattcctaaaaaattgctacaagaggaagttttaaaatttgatggataccaccaaatttctatccgaagcagttataccaatttatcttatcaaaacttacagtaaataattctctacacccaagggtgtccaatcttttggcttccctgggccacattggaagaattatcttggatcacacataagatacactgacactaacaacagctgatgaactaaaaaaaaaaaaaaaaaaaatcacaaaagaatctcataatgttgtaaaaaagtttatgaatttgtgttgggctgcattcaaagccatcctgggctgcgggtagcttgcgggctgcgggttggacaagcttgctttacatgatagcccaaactagatattttgaaatattaaaaattgttctcaatctataataattttaagtatttaaatttgtattaaagtgagcatattgtaactaaatcaagcatgttcctagcatgactttatttacagatagagttgacccttgaacagtgtgggggttagaggcgctgatctgatttgcagtcgaaagtctgtgtataacttttgatcccctaaaaacttaactgctaatagcctgctgttgaccagaaacctttccgataacataattaattaatacatattttgtatgctcttatatgtattatatactgtattcttacaataagctggaaaagtgttattaagaaaataaggaagagaaaataatatttactattcattaagtgaaagtggatcatcataaaggtcttcatcctcatgatcttcatgtctagtaggccgagaaggaagaagagtaggagttggtcttgctgtctcaggggtgtcagatgcagaaaacaacctacaaatgagtggacttgccagttcaagcccatgttgttcaagggtcaactatagttataattctataaaagactaaacctcctggagtatttgagttttcccaaaactcctatctaccaatctatctgcattttttatggataatctgcgttttagcttaccttatcaatattttctttaaacttattgatagtactgaatctcttaattactattaactttgttgatgttttctattgtttctacttccttttactttggtatgtagcaagctgctctccagggaagtatctctgaaacaaaactcacttaactcccacatttatttcaggcaggagttggcaaactatgatctgtccaaatccagcctgcagcttgtttatgtatagccagcacactaaaaatgatttttacattttaaatggttggaaaaaaattaaaaggagaataatatttcatgacatttgaaaattatatgaaatccagatttcattgtccataaacaggttttatttgaatacagctcatcagttatttatacattatccataactatttttgctacagtggtacaggtgagcagttgcaacaagatactcaaaggttaacattcttgctttctgactctttctttacaggaaaaaaaaaaattactgacccttgcactgtaagatcaagattaagaagagcagcttttgcttagtactttacaatattttaagacttcattgtgtatttttattatagattgagttaaaggaaagactgatgggaaaaatggatgagtccctaaatcaaattttcatggtgtgacctgattatcatttgaaattattttctataatattgccaagcaaattgtaagaccaactttaggaagttatgttttctgctgttacagattattaacctgttttctttccacacagtcaaattcagtgtaaagtctttggatgtgtagtctgagtttgttgtgtttctcagctttgagactaaaagtattagataattagtcaagctaattagaaagtatcttctggtgtctctctttaggaaaaaatatctacagtctgttaggtaaatagcttaggaaataaaagccatcaaaatcatctgggaaacttatttaaaatatgtatttcttagcctgaataccccctcccatttctgattataccaagaaaggaaagggaggcagattatatattttgaaaatgcctctgttagttaacaagagaaatgtctcataaattgtgtatctttttctaaatgtcagaataaatgatatacttaaatatgtattagggtgatagtcttaaacttaaaatatcatttaaatgagaaagtgatttctaatacaaagcctcaacttactaagttaattgagattattttaaagtttctccaaaatgcatcctccaaataaaaatataatttctgacagtgaatcacaggtaaccagtttgacatgacagatttcattttatcactctaaaatatatttcctcagtggatgaaatgaaaattttatagctctatagggaaaagtagatgtgaatattaatataacatcttatgtaaatatacactgtttgagattgataactaatttaattccttatattttgactattttccaattaaagtttacataacattttaaatcccaatgtatcctttttaaagatatatttattcgtgggtcatataaattagatgtcattgtccacaagaattatttggtgggtagtcagttttctatcaaactgaattttatcacactgtgaaaagaatgtatcaaatagagacagatccatcagtgcttgattttcttttgaactggagcattatatctgtattatgtacttagaattttatattcagtagtttagtttgatttaatagccaactaatatggcaaatctgggtgattaaaaaaagcaaaaattaaagcacatattgaatgactttataggctataaaagtaaaactcatcttttgttgaatttttagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacgaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagttagtagagactgtttttgtagttttactttcattaactgttgcttaaggtttttatacacttccagattttaattaatactttcatatttctaggaacatggttgatatgaaataaaggactttttatttgtaaggaaa

SEQ ID NO: 9017 - DNA, 11754 bp, Homo sapiens
gggctaaacatatttaggtttctgttgggttactttggatttttgaatgtacctataaattacagatggttccccaaagcctccaagactcaatggtaataaatagaatgacttaggttatacagtattgtattatgcattcataaagcttctggattatctagaagtgtttgctatttacaatgtgaagtttgcgaagtgccgcgtggatttttatgtgaaacaagcatttctgttacggttcaggtaattatctctgggaaaaaaaattatcttggactataaaagttagtctcagctatttgaccttggggtcttacgaagtaaggtaatgctttaaaatgcaacaattgttattttactcatattttatatagaaaggtatgaaacaccaaagagagcgctgaaaatggactcactgtcatcttccttcagttctcctaatgatccagatggacagaatgatatcttttgggatcagaattctccattgacaaagcagttaggtaattaattattaacattttttatgtgagtaaatatttgataaatgattcagatttaactagaattctagtcagataatagcatcgggaacctctgagaatgttatatgattttatctgtataagtatgtgatgtaaacacataatcctctaagctgcactaaataaaattactttctaagaagtgacagctgttttttaaaatggagggttttttgtttaaaatttatagaaatgtctttgtttctttaggtaaaggaagaaaaaaacagatttacaccacagatagtgatgagatttcacatattgttaatcgtattgctcctcaggtaaatatcactagttttacagtttgttttaaaacagtgaagaatgtgccactaagtttttgtagtttctttaaatgaaaagtattgtctattataattcttttttccaaaaataaggcagcaaagattactgttttgccttttctacttttgaaatacatattttgaaaaaaggaatataatataaaatacaagatattttcttaagtatatatcttgttttaattttttagagtaatttttgactagggcattgtgtttatctgtaatgttgtgcttaacaacatacgacatcatttttcaagttgctaaaataatagaataaggcagtgaaaaaagtttatacttctatgattgttttgtgattggtacttcctgtctgtaacatttccccattgaaactattaatactcatttccttataagattatcaagaaacacttacaaaagtggagagcactgaattcaaatttagtcctcattcaacctcctatgctgtgtgacccagtgcaagttatttaaactcccaccacttcagttcattcagccatgaactagaattattgtgttgctcttgctgtcttcattggatcattatgagaattaaactagataaaaattctttgtaaactatagagtgctataattgtaaggttacgttaaggttgttactgtaatagaaccatctccaaagcttttttttcttttcttggacaggcatggtgactcattcctgtaatctcagcattttgggaggaaggctgaggcaggaagattgcttgaggccaggagtttaagaccctgtctcttaaaaaaaatttttttttgagtgtttcgtttctttttttcatttctgttcttttattgtttgagtgaaatagaaatatgttcaagtcaatcatttgacacaaagcaatccagtaactctaatattataattactaagaagcaaaggctcaatacgtgaaactgttctgaacttctttactttttgttctctttttcttatttaacatttaaatccagagaacatttttgcttagtgtcttctctgaaggaagtatgccatttttccttaacctgcgcttgaatagttactatatgttgaccataaacaatagatggcactggcccaaaacatggtttgaagaattactgtcacccaggtggaagagacagaaaatgaagtttttcttagcagctataaaatatccaaaattacacctagcacagtcaaaacaactctgttgctactagctctacattccatttttagcatgtcatagaaattcattttacttacagttaattagttaaatagcatttatgccataatagtacttactctataagttaacaatagatcttcattaattgtgggtttcacatgaaagaagcataataaaatgtgtttgggtgggccagtctaaatagtgataaaaagatagttgtgaataaattattggactctttacctaagtgggctagaaataatagctcatataaagaaatgacaacagtacgcaagtggtaacttgtataaaagaaaaaaatatagtgaaattagtagctttaaaatgttaccctcttaaactgagtacttttaaagcatataaatctttagcagtttcaaggtctgtttgaaagcttgtcatgttctcagaatgacaaatacttatattgtttatttttaggtgagtcattctcaaatcatttagttttaacattttcagagatagcatttttttaaatatgcgcttttattttggttggacagtcagttcactttttgcagggatacttttatacaatgttgtttatttgaagatggtatgtatcttcatttatacagctttgcacagtatactttttataatgaaatgaagtaatgcatttagataccttatacagcacctggattatggttgaaaatcaataaattatgtaattattcatgaagaaatatgtaataacatgtataaatagtatacaaacatacataggacccatgtatatgtaaagttgggtacataaagtcataatttagttctctgaaaattgaatgaatttaaaattacttttgtaaatggcagagttcataattaagactatgattgtctttaaattcaagattgttgaaataaaagggaaaatatattgagtctgaaagtgaaattactgattttcttgagtatttgcaaagctaaaggcaactaggttcaagttgacattaagaaaacttttttgattcattgaggatttgaagtaccaaactgtagggatcttttcacctaaatcttctagtaaataaatgtatactgacactggtatgcccaatattgtgctggatgctgagttattctaagaagagtccttgcctttgagtagcctataatctagtagtaaaattattttttaaattgtgtgatatttatgttcattctaggtactataaaatagagtgaaaatggttacttgatttgatttgttggtttggtttgcaattaatgcctaaagctcattctgtaatttttttgtgtgatcaagtgactgaaaggtacagcaaaagtatccaggtctaaaatgccttttttctgtatattatctgggctaaacttttctgttttctctatttttttattcttattcctgtctcattcttagcatcagttctaaccttgctcttatctcttaattcattcctgatcttaattctgagtgttcttaatttaggtcaacatggattgtccaactttagataaagattataataaggataaagaaaatttggagaaacagatgatacagaaagaattccatatgtatctcctctcaattctgatgatttctgccacacagtttctgacactaatgtttttataagtatcttaggacaattaaaatgtcaattttcttttgataaaaacatgcttctgttattaaatgtacatttgataaatttaattcttaaaacaatatttttttaaaataagcaatttgtaattctgaatgttttcattctctgaaacataagtggatcaattattgtagcttattattgctatctcccaacttcctattgtttttgagtttggtaagtgttacctcaccagaatttaggaaattaattcaaaatcattagtttttattgtcttttttctttcttttgtttttttggaagacgggggatgctacactggtactttatacctctttttttccctatctgccaaaggatgaaaaaccaacaacaaattctatgctggacatgtggattggtgaaactgctattccttgtactcccagtgtagcaaaaggaaaatcaagagcaaaaatcagctgcacaaagtaagttaagacttttcagcttttctgaaattcagtgaagcaaatattttttgataatactccattttggttttgtgaatatatcaaaatttttgttaataaaatttccacagttttgatctatcaaattttggagttaaaataattataactgttaaaatcttagagctttaacatcaaaatatgttaaataacagttggatataatgtttcagaacatttttagttattttttaatcttgtttaataggttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgtagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaaggtatgtatgaaatatgaaatagttttctttgaaaagcatcttaaaaagtagtaaaataattatttgttgtttttgagtgtgagtaatgtataaggtaaaactattctatgactagttaattttaagaattaactagaattcttaaaatgatacttggaaataattatacggcattatacagagtagttggtttatttttcaaaatattacattgaattctttcccagcacttaatacaatgactggcatatagtaggtactcagtaaatattttttgaataacttattctttcttggaaaatcatacctttagatatatgtattatagtgttcattaagattgtatttactaaattgttttaaaacttgagtaatctgggaagcagatgatgaagcagtgaggtaaataatatttagaaatttagagcattctaattaaacgtctttactagtgtgatatttgatataaacgtgctagcggtgatggttaaaattatgatttacttatttgataacagctatcatttctgattcttccaatttctcttttccccaagtctccattctatcaataagtttcattctttcaaaaaccgtatccccagactccatttttctttctacaacaagttaacatttcttgatgagactactgcagttcttttatctatctcctttcaattcttatctccaaacagtggaatagccttttaaaattggatgggcaaaaatggcgtttctatgcttaaaacaaccttcaatggctgcccgtcatatttcaaataaaatccaaactgtatactgtgaccaacaaagctgtggattatctctctttaacctgcgtctcctcttttttccttacctactaagcttcagctataccagctatcttttagtttttcaaacagtgtatgtttttcttccttgtccaggaacttagaccgtgctcttccctttgactaaaactacttcttttcaacatgtgaccccttccccactcttttgttggtgctttcttacatctcagtataagtactactttctcacagaggccttccttgaagagtctataaatagatctccttgtttattttttatttcctaattgctttcatcacaagttgaaattaaatatttagtgactcttctctgtcttgttggcattactgttccaactttcctatctaagtgactttttttaaaaatttacaatagtaatatgctagttatttaaaaagaaaagtaaaacagtatagaataatttaaaggaaaaagttaagtcttctgtttctcctttctgataaccatcccttacggaaaaccactattaatagttggtatgatgtagcattttctatgaatataaaaagatatgtgtgtgtgtatgtacgtatatatgtgtatgcatatatatatacctatagatctatttaaatattaataaatctgtatacccactatttggcaacttgcttttgccttaatatattatagctgtcttttcctattagtacatataaatttattttagtcctgttaatgactatgtgatatatatggtggatgtatcataatttaactgtttctctgtgatggaagtttgggttggttgcagtcttttgcaattacaaacaatactccagtaaatatccttctgcataaatttccgcatgcttgtataattgtatctgttaattcctaaaaaattgctacaagaggaagttttaaaatttgatggataccaccaaatttctatccgaagcagttataccaatttatcttatcaaaacttacagtaaataattctctacacccaagggtgtccaatcttttggcttccctgggccacattggaagaattatcttggatcacacataagatacactgacactaacaacagctgatgaactaaaaaaaaaaaaaaaaaaaatcacaaaagaatctcataatgttgtaaaaaagtttatgaatttgtgttgggctgcattcaaagccatcctgggctgcgggtagcttgcgggctgcgggttggacaagcttgctttacatgatagcccaaactagatattttgaaatattaaaaattgttctcaatctataataattttaagtatttaaatttgtattaaagtgagcatattgtaactaaatcaagcatgttcctagcatgactttatttacagatagagttgacccttgaacagtgtgggggttagaggcgctgatctgatttgcagtcgaaagtctgtgtataacttttgatcccctaaaaacttaactgctaatagcctgctgttgaccagaaacctttccgataacataattaattaatacatattttgtatgctcttatatgtattatatactgtattcttacaataagctggaaaagtgttattaagaaaataaggaagagaaaataatatttactattcattaagtgaaagtggatcatcataaaggtcttcatcctcatgatcttcatgtctagtaggccgagaaggaagaagagtaggagttggtcttgctgtctcaggggtgtcagatgcagaaaacaacctacaaatgagtggacttgccagttcaagcccatgttgttcaagggtcaactatagttataattctataaaagactaaacctcctggagtatttgagttttcccaaaactcctatctaccaatctatctgcattttttatggataatctgcgttttagcttaccttatcaatattttctttaaacttattgatagtactgaatctcttaattactattaactttgttgatgttttctattgtttctacttccttttactttggtatgtagcaagctgctctccagggaagtatctctgaaacaaaactcacttaactcccacatttatttcaggcaggagttggcaaactatgatctgtccaaatccagcctgcagcttgtttatgtatagccagcacactaaaaatgatttttacattttaaatggttggaaaaaaattaaaaggagaataatatttcatgacatttgaaaattatatgaaatccagatttcattgtccataaacaggttttatttgaatacagctcatcagttatttatacattatccataactatttttgctacagtggtacaggtgagcagttgcaacaagatactcaaaggttaacattcttgctttctgactctttctttacaggaaaaaaaaaaattactgacccttgcactgtaagatcaagattaagaagagcagcttttgcttagtactttacaatattttaagacttcattgtgtatttttattatagattgagttaaaggaaagactgatgggaaaaatggatgagtccctaaatcaaattttcatggtgtgacctgattatcatttgaaattattttctataatattgccaagcaaattgtaagaccaactttaggaagttatgttttctgctgttacagattattaacctgttttctttccacacagtcaaattcagtgtaaagtctttggatgtgtagtctgagtttgttgtgtttctcagctttgagactaaaagtattagataattagtcaagctaattagaaagtatcttctggtgtctctctttaggaaaaaatatctacagtctgttaggtaaatagcttaggaaataaaagccatcaaaatcatctgggaaacttatttaaaatatgtatttcttagcctgaataccccctcccatttctgattataccaagaaaggaaagggaggcagattatatattttgaaaatgcctctgttagttaacaagagaaatgtctcataaattgtgtatctttttctaaatgtcagaataaatgatatacttaaatatgtattagggtgatagtcttaaacttaaaatatcatttaaatgagaaagtgatttctaatacaaagcctcaacttactaagttaattgagattattttaaagtttctccaaaatgcatcctccaaataaaaatataatttctgacagtgaatcacaggtaaccagtttgacatgacagatttcattttatcactctaaaatatatttcctcagtggatgaaatgaaaattttatagctctatagggaaaagtagatgtgaatattaatataacatcttatgtaaatatacactgtttgagattgataactaatttaattccttatattttgactattttccaattaaagtttacataacattttaaatcccaatgtatcctttttaaagatatatttattcgtgggtcatataaattagatgtcattgtccacaagaattatttggtgggtagtcagttttctatcaaactgaattttatcacactgtgaaaagaatgtatcaaatagagacagatccatcagtgcttgattttcttttgaactggagcattatatctgtattatgtacttagaattttatattcagtagtttagtttgatttaatagccaactaatatggcaaatctgggtgattaaaaaaagcaaaaattaaagcacatattgaatgactttataggctataaaagtaaaactcatcttttgttgaatttttagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacgaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagttagtagagactgtttttgtagttttactttcattaactgttgcttaaggtttttatacacttccagattttaattaatactttcatatttctaggaacatggttgatatgaaataaaggactttttatttgtaaggaaa

SEQ ID NO: 9018 - DNA, 181 bp, Homo sapiens
tcaagcgattctcctgcctcagcctcccaagtagctgggactacaggcgtgtgccacctcgcccggctaattttttgtatttttggtagagacaggggtttcaccgtgttagccaggatggtctcgatttcctgacctcgtgatccacccgcctcggcctcccaaagtgctgggattacag

SEQ ID NO: 9019 - DNA, 13165 bp, Homo sapiens
agagaaaattaatattttataaaattctattagtttgaggttaaaaagaaaaatcaacggcaaatttaccaactttttcttaaaagcacagtgaatccaaaacagataaaagactacaaaccctataaaatgaatttagattcattttctactgcagaaacattaaaagtaatttggatgatttcctaaatcttaaatggtgcaaaaggcggtttgcttaattatgattgctggcgatgtggatgagtcctcctgtctgctatgaaaaatgttcttgctcagggtcccttttatgaagattcctgggaaaaatcattttccagtcctagtgtcaagaacagttatactattggttaaaaattcatttacttttggcattggctattagagaatttctggcagtgagtttaaacagaatacttgactgcaaacaagttataacagttacccaactgtgtccttcctttgctgctaagtcaggttgcctttactttgaaaaaggtaaaaaggacaaaacatatctacttaggcacgtggaatctttttgtttaaagtgtttttctattcgttgctacaggtacagagtaaaaaaataataatcacaaaggttctgagaactggaaggagctatggttctcatctcacttctagaattaactatgaatcatgtctttttcatcacccattcctgggggccctccattcagtgttgcatggtgagaagaatgctgaagagccaggagaggaaggctcctgtttcagccccactactaattggcatctggctctgtgactttcttgctttgggtcacagtaccctcagcttaaaatgaggatgctggtctggacaatctctaaggttcttctagaatggaccttgtcttcattatagaatgatagtttaggaacagtgggaacacatttccactccagcctctgattgaggccagaagtgaatactctactccactatggtccctgtgcccaaagctccagccctctaaggatcttgttgcatagctatcagcattctccatgaactcctttgtgaccagctcctgagcacaagattctttaacatttcctgtccataagtgaccatcacaccctgcaggcagccaggctttaggcagtggagagacgcggggttccaggaaccctgcttaagcacggcatgctcaggagagactttcttaccaaacagctcaatgtagacctcttgaagcgtgtgcacactgcagaactggttcagttcgtggtggatcttgttgaagatgagggccttgtcatagtcagcagtatagttcttcactatatcatacactgagaggaagggagagggcttggcataagaaaaggcaggactcaaaatcccatcagacacggcaggtgtcatttaccaaggtgctacaacagacacgggagtggcatgctggggaaagtgagctggtggtgtgaataaactgttaagacgtacctgcgttcgggaccaggaagttcaccacttcaattctgtcaaagtagatcatcacaccaccactattggagggagaatggacaagaagtcactgggaagccttagaatatggtgcagtcccccagggtgatggcgtaagatgtggggcttggcagaaaaggagtagaagagttcacgggaagttggaaggcagcttggatctccaagtgggaggttctgcagggctcatggcaacaacatactctcctgagaaatcacactgcctaggaacatctctacaaagacatgaatgagacttttggggaccagtacgaaagagtaactcatatctttggaatcagcaatgccttttgattaatcagttgcacggaaaagactaaggagggtcaaggtgaagttttcagaacttagaaggttactgtggaatgttatgatcaatgtttcttaaactgtcttcactattactttggtgtcacactccctttgccctcaaatatttattataaaaagatttcaaacatagagaagccgaaagagtagtataactaacatccatatccagatacctgaattcaacactgataacattttaccttatttattgaccttttttttttctgaacatttcaaagtaagctgcagttaggatactttactcctttactttggtgagcactgtcttaagaataatcattctcctacacactcatggtatcattccaagcctaagaaaattagcaataattctgtaatatcacctaatacccagtccttattcagatttccccaacagtttgtgttatggactgacctgtgtatgcctcgcccccagattcatatgttgaagccctaacccccaatgtgactgtatttggagattagacctttaagaaggtaattaaggttaaacaggtcataagggtgggctgtaatccaaaaggtctggtatccaccaaagacctttttctctcttcttgcacatacagaggaaaggccttgtgaggatgtgacaaaaaggtggtcacctgcaagccagaaagagaggtctcaccaaaactacccctgctgttacccggatcttggactttgggccttcagaatggtgagaaaatatctattattttagtcccttggtgtgtagtcctctgtcatggcagcctgagtggactcatatagtttctgtcgtatctgttatagctgttaattttgaaccaggttctaatcaatgctcacccttgcttctgtttatgtttcttgtaagtctctgtccaatccagcatccctctaaatacaaccactttgtgaagagatcaggcctgcgatcttgtgggatgttccaattccggatttgtcagagtgtttctttgtggtattctttgtcactctatcccagtttaaactgtctttgctttccagtgggaccgctgtagcagtgttctcttcggatctctttgccctgaaggtctcccctacctttatgacattctctttagttatgcaagttatcttcttgtatcaggtcatttatctgctaaaaacctttgtgcatcctcacttctttttttgtttttaacgttaaaattttattttattttccattgtttaaattcagaggtacatgtgcaggatgtgcaggtttgttacataggtaaacgtgtgccatggtggtttgctgctcagatcatcccatcacccaagtattaagctcagcatctattagctattcttcctgatgctctccctctccccaccccctatccactgacaggccccagtgtgtgttgttcccctccatgtgtccatgtgttctcatcattcagttcccacttataagtgagaacatgtggtgtttggttttctgttcctgcattagtttgctagggataatggcttccagctccatccatgtccctgcaaaggacatgatcttgttcctttttatggctgcatagtattccatagtatatatgtatcacattttctttatcctgtctatcgttgatgggcatttgggttgattccatgtctttgttattgtgactagtgatcctcacttcttttggtctttttttttaaagacggagtctcactctgtcgccaggctggagtgcaattgtgtgatcttggctcactgcaatctctgcctcccaggttcaagtcattcccctgcctcagcctcccgagtagctgggactacatgcatgcaccaccacacccagctaatttttgtattttagtagagacggggtttcaccatgttggccaggatggtctcgatatcctgacctcatgatccacctgcctcagcctcccaaagtgctggattcaaggtttgactcaccgggcccagcctgatcctaattgataatagagtaagtgcaaactccttatcacatacagcattctagcccctcctgaaccttctatgatttcctctactgcactccatcacctggtcaaatcaatatagggagctacgagacagggaattaaccaagaaagggtgcctcccttttcactgtctcttcctgcaaccagccagacagccttttctctgacttatttgggcttaaaagctttattctgggtaccttacctagtcccacaaggtacattcttcgcctcatctgtctggagtgtggtctggaaacagaggaaacataaagtgctagaagaaggacagtgacaaagtaacttacttttcagaatcctaaatgcctttgtcctggaataactgtttgggttgagcatggcgttcattaaacatgattaccccacctaatcctccttcctcacagggttgctaagccaagtaaaggcccgtgccccagcctcactataagtgaaccaccacatcaacaagctgagtaataatggtttagtgaagatgacactggattgggcatcttaagacttgtgcttgcttctacctcttctatttatgttaggcaccgctttatgttcgaaggcccccagtggatgcttgaaaccggggagagtaccaaaccctataacacatacctatgataaagtttaatttataaattaggtacagtaagtgatcaacaataataaaatagaacaattataacaatatactgtcataaaagttatttgaaggtggtctctctctctctctctcaaaatatcttattgtactgtagtcacctgtttcaaccatggtttattgtgggtaactgagcctgtggaaagtgaaatagtggataagggggagggctgttgtactagttttgaaacagcagattacctatttaacctgtctcagaccctagcacatgctcagcccattctcaggattactacaaractcaaatgagacaatgtacctgaatgcagtttgaaagccacaaagcctggtaaacagcacatgaaacttacagggaaaatgcctagcaggtatcccaagacattctcctgggtcagtgtaaagtgtaaaatcttgttattcttcttagctggacatacttcaagagaatggcaagtccaacttagccaggctttagatttgccacaactaacctcactcctattttagatgtcacctcccctcacttagtttaactcctccccactcactgcaaaaattatgtttgtatttctgaattcaaataagaatcagcaaaattactatgttttctttccatttaacatggtagcctgtgatttaaaacatacacacataaaccctgacttttctttccatatactcagaacaggttcttctctggctttatcttgaaggaataatccccagcctcattttatatatatatagtgtatgtgtgtatatatatatatattatatatatataatatgtatatattatccttatatcattctctagaatggcattttactcatccaatggctaaataatttcaaatcatgcactagttaacagcccaagtttgcagtcgtccagccataccacagaggccaagcatacctgcacagacttatatgatgtgatgaaagggagcatgagatggaaaccagggccgctggtcgaagtcagcagggcaccgcctctgcagaggagggggaagagagaggcagcttcagtttggcaagaaggctctgttagatcaatatcatgagggtcaactttcccttcagccctataaacatataatagagagtgacatgtgctgcagccatggctacagatccctttcttcctctcagctagatcctaatattctaggaagcctgatggtaaaacataaaactattgttcatgcttttgcaaggagaaaaataggcacataggctaaatggaataaagacagcagaacccactagtgcagtcccagcgctttgcggggctgaggtgagaggattgcatgaactcaggagtttgagaccaacctgtctcaaatagtgagaccctgtctctacaaaaaaagaaaaggaaaaaaattagctgagtgtggtggttgtatgcctatagtcccagctacttgggaggctgagatgtaagaattgcttgagcctgggaggttgaggatgtagtgagacataattttgccactgcactccagcttgggcaacaaagtgagactctgtctaaaaaaaaaaaagaaaaagacagcagaatccatgggtatacttagataagagaaagtctggccaggcgcggtggctcacgcctgtgatctttgggaggctgaggtgagtggattattaggtcaggagttcaagaccagcctggccaacatggtgaaacctcgtctctactaaaaatacaaaaattagccaggcgtggtggcaggcacctgtaatcccagctacttaggaggctgaggcagagaattgcttgaacctgggaggcggaggttgcagtgaaccaagatctcaccactgcactccagcctgggcaacacagcgagactgtctcaaaaaaaaaaaagataagaagtctgttttactttgtcatatctgttgggcttgtggcaatccattagggcagttaagtccagtaatatggttatcaactacctgcactaatgctggagtccaatgacatgaccaaccaaaagaataatttgaagtactttataaataattgaaatatatgttttggcaatagagttacctttctaatcaagttatatgtaaatgatgaagttaaaagcctttttggggaacatgtaagcagatgatggggagaaagaattaaaggagagaggaattccaatcagagttttagaacttgctgttagcaatccagaaacaagcatcacaacagcacatataagaagagttcataaagacataaaggcaaaacacttggtcatggaggttactaaaaagaaagcaacccaagacttataagtgcttctttgctttatattaggcaaagaattaaaaaaaaaaccaataaaataaacagtgacataatgggttcctttattgtaggaaccactatcctaaggcttgctttgattgacgtaagtcaacctgcaggctctttcattttccttgaaatgttaatattattttatttttagaaacagggtcttgctctgtcacccaggctggagtgcagtggtgtgatcatagctcactgcagcctcaaacttctgggctcaagtgatcctcccacctcagccccccaaataactgggattacaggcacgtgctgccatgctcggctaattttttactttttgtaaaaatgggctctcactatgttgctcaggctggtctcaatctcctgggctcaggtgatcctcccatctaagcctcctgagtagctaggactacgtgtgtgtgacaccacagccggccaattaaaattttattttttattttatttttttagagatagggtctcactatgtgacccaggctggctgaaatgttaattttaaaagagcatcccaaattagcagagtaggctaccttctcaagttgccatcaagaactggtactcagctggcttttgtaaaggtaacctagcagtgtaaagctaagactgccagagggatgtaaagctaagactgccagagggatgtaaagctaagactgccagaggaatgtaggagaaaacagtattttagggatgatcaatgaggagcaccagtttcctttagattttgtctctaaatctatatacacatttattaatcaccacccatggcatcatcttggactactaagtgaagttctaaatttacatatatatgtgtgtgtgtgtatcctctttcccgtggttactgacataaaaagctccatctgaaaaggctcccctattcaaggaaatataaatagagatgttcagcagaatctgctaggaaagcaatgaccaggaaagggagctatttaacaggaagttgccggcttctccctgtctctgccttacctgtaatataccccaatatgtccctcttctatcttgtgcacagctgagaagagagatgcacaaaagaaactggaagccacagccacaactgctcccaactgagccatcagtgagcctttatcctagggaaaagacacgggaaaatgtgtgtggtccaacgtgcaggagaaaaggccacaacagcgagaggacctcaccaagctgagctccctgcgagtgactcatatccagcctggtgtcgtgtgaacacaaggctagatctacaactcgcttcctcctcgttctcagtcaacgttcccctttctttaactgtaaaattagagcccccaccgcactgaggaagcactggctccggatacagccgttgctcaagggagaacccgtgccagctgggtagggttcagaacacagccttgtcttcctgtgaacacgaatgtgctgtcactgaacctttcctaccagtagtagggaagagaggcagctgcagtactttggcccaaattacagaggatgccaaatgacaggcagttgtggctatgtaattctggtcagagtctcccactcctaattgcctgcagtttcaaaggaaaccattatttactcctttcagatgctggagtggcagagccagcaggcgagcagagtttcaaggtaggattcgttggcctcgcatccaccttcccagttattcctttggccctaaacaggacagggctctgaacaagcctgaagccacactcccccccatatactttggcactttgcacctgacagatccccaagcccgtggtcagagagaaaggcaatgtcccaaactgcgagcctctaggctcctaggtccaaccgcgttcaggcaccaggacgcggaggagtgggatcctgaacgctgaatgatctggaactatggtgactgactgcaaagttcagctgtgcgtgcgtgggcccgtgagcgcagggcgtggattctgcctcccaggtctaacgtaaccggggcgcggacatctgcgaggcgcttattttaccgtggcggcctccggctaccgatctgcagttgcgtcctttcctgccagtgcccttccctccccgaggtcactcgcgccccttccccgccccgttccgagagagggtcaagcgccctggtctggggctgcggctccaatagcctccgctcggtccccctgcggctcgcaaggagaggacgcgacagaaaagggtttctgtctctctccaggagcgggccggctgagggagagaagctgctgggactgaggttcccgaaagtgacgggtcagccccgaccctgagcggcagctaggcccagcgcgcgcacgaaggggcgggggccgcgtaccaggctgtccctgcaggcgctccgtactcgtccgagcccacgagcaagaaaaccgtcacacccctcagcacgcgacttccttccgggccgtcgcttcgatgacgccatcaattcacgcgagaagaccacacccccgccccgcgctcgtctggcccccgcccctcgcgctcccagcggtcaatggccgtagtggccgccagggatcgcccgcgacttggtcggtgcggtcctggacctcggtcttgggtatccgtcctggggctggggatgagggcggtgttggtgggagctccccgagagcgagcggcaggacgcgcatgccccggagtactgagacccagggcgaacctttccaaggcgttgactttggggattgctccggatttccttttgcattaggccgaacctggttcgttttggtttttttagagacaaggtctcgctcttttgcccaggctgggagtgcagtggcacgatcatagctcactacagcctcgaactcctgggcttaagcgatcctccccacctcaccctgctgagtagctgggaccacaggcgcacgccacgacacttgacaattttatttttagtaaagacagggtcttggtatttctggtctcaaactctggcttcaagcaatcctcctgcctcggcctcccaaactgctgggattacaggcatgagccaccatgcgcggcctttttttttttctctccttgataaggtactggcgagttgcaactgtttgctttcctatagcacagctgaaatgaaacagtcttttcaatgtacagattagcatcattacctcaccaatcaaaaatccctaccttgagttgttctttatatttttttgggagctttggcccttgggatcctgcaacgccacaaagtatattaacaaggaattattattctaattttaatgaacggaatctaagaagttcagcgaggttcaagggtaaaagccaaggaaagtttcctttgtgtttccttaatatcttgagttcactgctttttaaactcctgccacagtgcacaggggctagtgcacttcgtctttctagataaactgtacgttcccgggagagcagagactgactttccttccgcacccccggggcttaggtgcccagtaaaaacagactgaaggcaacgtgggaccaggcccggaatccagagtttgtgtctcctagtctaagggcctcacgttgtcctccacctgccctattcaccagcatcacattggggcatttctaattcagccactgaggttattaatattttgtttgcaggagagaaagagtccacttaattatagccttcagtaaaagaaaaacttttacaccgggaagatggcaagctggtggtgttagacagatttaagactcaggaaaagggaagtgtggttttttccaggcatgcctgcttgggattggcccgtttacctttcctgcgtttgctctgggtgttgggatgtttcagcattacatggtgaaacccatacgagggttacatggtgctgtctgggagctctgtgcccatctccataaatgaaggcctttcatctccctactctgtccctgcatcccccaccccaaacagacacagctggccaatctctcgatcaatcctatcagaacttgagttttttctctccctgttcagtgatataacctcagctgggcatgcttatttaatagtttatttaataattgagtaagaaaaatggaaatattagggttcatcaacccatgaaatgggggctagcctgcagcatcaagtatttaaattacttgtaatttaagaatttcctttaaccaacctctggcaacccgtctcccctccccttcccacaaatatgtatattattatgtgtcaattaaaaataataaaaacacaaaaatttcctcacattaaactttggagtgaattgtgggtagaagttttgggattttgttcttaggagtcattttaccagacctgagttatttagttgtggacgtgcctaaagcagggggatggacttcgtgatgtgctagtacatgatgatctagtacttctgaaaatctctttcttaagagacctgtgatttttatgttacccagcagatacatttgtgatgatttgtttaacaaaaatgtttacaatttctttttctccttccttccttccttccttccttccttccttccttccttccttcctgtctcgctctgtcacccaggctggactgcagtggcgcgatctcagctctgcaacctttgcctcccttcaagcgattctcctgcctcagcctcccgagtagctggggctacagacgcatgccaccacgactggctaattttgtatttttagtagagatgggtttcaccacgttggtcaggctggtattgaactcctgacctcaagtgatccacgtgccttgggctcccaaagtgctgggattacaggcgtgagccactgcgcccggctaaaattttattttttaaaaaacctcacagtatagagtagtgatttagctcagatacttcacagtcaggctgccttgtttaaatcctggagcctgcctcttattctgtaacattggaaaaatgatctatccctgcctcagtttcttcatctataaaattaaagtaataatggtatgaaacttataggactgttgtgaaaagcatatacaacatttggtacattttaagtgttcaccaagtgttagctgttgctgttttaaatagcaaattcccttaatgtattcttgcatgtttgtgggttatcattgcagattattaatgtgacacagggcgagagaatgataaactttaagttgtatggtattaaataataaccaaatgaaggcttatcagaagaagagataaaggcttctgaaattatacctcaatggatatttacaatacagatttcataaagctttattgaatactgtctatgtatcagccccagtaccttacattttctcattttatgtaaactttaggtcagccctttgagttcaactccattttagaggagaaagtggaagcttagagaaattaagagattgtctaagatcacgaagatgataaattgcaaaggcagagttcaaatgatcccgtctatttcttttttatagtgaatgagttagaaaatgattcaatttcagacacaaacacacacacacaccccacatttatttcacatgtaacctttcagtaatgtagatcagtggtcagaaactgaaatttttctaattaaattgggccagttcattttgcagttgtagattgaagcaggttaaaaaatactctcacctagcaatccatagttttctatttctattgctgtttgttgggtcctcttaccaagaaaattgttagtgagagtgccatgccaaagaaagagaccccttctttcacaattaggaatttttaagtcaatttcacaattagactttttaagccaataagcaggtccaaaggattcaggcaactcttaaaatcttctgcttcagttcagttcagtatcacaagagtggaagttgctggaaaaagtttccgtttgatttaaagtttatctttttcactttaggccctaaaacagggaatagaaataatcttttagaacatttgattccagtaagattttggtgagcttatgggaagaggagtgaactgtatccttagttattaagggggctcagaaatttttcctcttttctttttttttcagttgcaaaaaccaggattggtgccttccaagaacaaaagcatatttgcttggggctaatgatgtttcttcaaggcattgggtaaagagatcaaagagccatcaggaaaaaaattgagttgaaagtcagctagaaggcacctaaaggtccttttgtgattacacatttttacagctttattgagatataattgacatgtaataaactgttcataaagtctacaa

SEQ ID NO: 9020 - DNA, 588 bp, Homo sapiens
tctgttgtgtatcttttaccttacatttgctatttacagaggagtgttgtatacataggtattattttatgtcacactgcttcagtgataactatatccatgtgtttgtatccatgtttttatccattcaactgtattaaaaggtgttgggacaggaaaaaaagttgtattactaagtacacacaaagaggttcttcaggtaaacttcaaagtattagataatactttaataacatgggcaaagaggatgcggcagagtaagaagtgatgaaaattatgcagcttcatgttttaagtctgggctataagagtcctgagagaaggaaagtatagaagaaccttctgagttgaagggccaggactagagacatgagctcctcctttatggatatgacagattctaagccaagtagtgcttgctagcaagactgagatgtaaaaataaaaaagtttcaaagcaaatatatttccccagctcctccatacaagcagctgtacttcactaagctaccaagtttagctgtaagaaagtaagaagtttgctaatgaaaaacaactttgtattttaatttcctcttcagggacatt

SEQ ID NO: 9021 - DNA, 102 bp, Homo sapiens
aggctggagtgcaatggcgcaatcttggctcactgcaacctctgcctcctgggttcaagtgattctcctgcctcggtctcccgagtagctgggattacaggt

SEQ ID NO: 9022 - DNA, 2013 bp, Homo sapiens
ggttcggagcgaccttggccgttggcctgaccatctttgtgctgtctgtcgtcactatcatcatctgcttcacctgctcctgctgctgcctttacaagacgtgccgccgaccacgtcgtaagcgtgcccaccctgccccactgtgaccccctggggtggtaagggaagctgaccaggccctgctttggctaagctggagggatgggtggcaagcctggctctcaagacctggggagatggaggagggtcctgactggaattctctttgcagcggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgctgccccctttcttcctggcctcggctgctggaattggaa

SEQ ID NO: 9023 - DNA, 1901 bp, Homo sapiens
agggaaagtgagggacaaacactgtgccctcctccccaggtccctgggtgtgggcagaggtctgtgctgccaagaagggtaggagccaattgaccactcagtgctatggggcagcgggggtctttattcgtcagattttccttcttggcctactccccaggtgtggccagggatagtccatacagtgtggctactgccaaggtcaggatggccagcagacccagtggggccagcagcccctccctggatagggctccagggtccttcactggaggaagatccttggtacccctgctctctccaaggctgggactagtgttcctggttgtggccaggtgtgcagtggttgtgacagcagatggtcttggcttggtcctagcagaggctgtgaccccatacatgggcctgatggtgccgaaaggcctggcgtgagcatccacccaccgcagcagggcctgtggtctccactgacagatgctgagcagggccaggacatcaccctcagccgtgtgcgagtctggaggggactgcccatacaggcgagtgtagatgctgcctaggctgtagctcttccttgggccgtgttctgaggggctgcttgctcgctccagggccttcagcgcagtgatgctatccacacagaaggcaccatccagagcactggtgaggcccagcatagccagctctgcttggagcagggggaagtcgtagcggtcaccattgtgtgccaccaggcaccagggctgtggctggcgccgcaggaaggctaggagcaggttggccaggttgtcatcaaaacattgacgcccatgcgctgccagcacagctgtgctcagacctgtgatctcgctggctgcagggctgcaggccttccccggagccacacacagggagagcttgtctaccacacgcggtggtggaggaactgtgggaggtggcccctgagaggtgggggggctctccagggcacatctgtggacagccagcaggcacagctccgtgaccttgggctgggagaagggcaagccagtggcctccatgtcgaaaaagatgagggtctgcatgggccccgggggcagggcctgcgagcccatggttgggtacgtacctgctgctgagcctggagaggagcatggggtgggtgtgtgagtgcccagtgttaagatccgaaggggagggagtggggtagggggtgggcagaagcacatctcaggccttccctgcacaatcctgccctgtctgcgagctccagggcccattttcaggcaggaagttggagagggtgaggtggtttccttagtgggaccagcacattcgactgtctgagagggtctccctcttcacatgactcggcccctcccctagtgcccccttagtctggggtgggggaacccatggccctcctgccctgcgccatcccattgtgggggccacactcaccgtagcaggcaggcaggcaggcagtagtgactcggctgcacactctcccgcggctctcgctggcagcagtggcggtaagtgaaacttggcgtgggcccgcctacaggcccacgtgagccaggcccgccctgctcgtcagcctgcctggtctgtccctctcaccaccatccgttcccccccacacccactcccctgctcccgggggaccccagaggccttccaagatccacagctgtggcctgctggtggcacaatgcaccggggccatcataccagtgacaggcagctggaaggaccagggcagtggtgccagaccagctcccggtcttacacactgctgggagcccctgctgcggccctttcatgcccacctgtgggtcccagtttcccaggctttcctggtttaggcctgggccaagagccacctccttccctgccacacaatggtttcttcccatggc

SEQ ID NO: 9024 - DNA, 41123 bp, Homo sapiens
gcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgcccggcatggcctccgtcctgcccgccccacagagggggtcggctcgttcgttcgtgtggtcccggagggcaccgcggactgggggtgcctggcccgtcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttttttttaaggctgaactccgagcagctgtgtttttagcactagaggagcaagaaaaagtagaggtatgaagtttccagattttaacatggctgtattcgttaatacttaatttcttattcattaaaaaccgtcttaaaaatagtttatagtaacatatagctagggataattttgaactgttaaggattacattactattgagagagagccaaaattattcttttttcgtgtagcttttgaatttgggggtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatgaaacggggtatatagtatgcaacttttcccaaaattatctgaccactcaattattttgacaatgaaaaagacagcgattattttaaaagtgcagccactactctatatttaagtgggtaatttaactttttcggagtcccaccaaccatcctgagtaaatattctggaatttgtcaacaagaatagaaccatcatcaaagccttaaactcttgctgtatgacaaatcagtctactgtcctctcacttctttagacctgtatacctaatctctaatttcatcaaaatcttcagttctttgccctttccatgtctgtgcaggcatcagtcttctcttggcagcattttgctctggaccctatgggtctggacccctaattaccttgccttaacggtcatacgtggtctggaagaaatctcagtggtcatttaacccagcaaactaactcttcccactttgcacatatgtgctcttggagaagagtcagtcaatcctgtggattgctgatgttgcaaattggcaggtaccaacctggttaggtcctgagcaggcccagcagctctcttcttcaccctagctgtgcagtagccttctatgtcacccctgcttccttctctctgaacacatggtcttgttgcttcctccacagggaaggtagaagccattagatcctaactttatgtcctcctctcctgtccctcaatctattgctcacctgtgaaaatgcttacctgtgtctatatttatctgtacctctttccttactgctttagaagaagaggctctgtcctgtccaagaataatcactctgtcttgtgtatactttcaagtctttaattatttactgtatctttgaccccttccttttctgatggcttttcttttgagcttgaaaacatgtttaaataactattaggagtaaactgttttcctttactcacattctgcttttaataccgctgtggtttttttccttcacaacctggttttgaccactccttggtttctttagcatgatctttttcctgtacacctgactgagacttatccacagttgtcattctgtactgtctcacagactgaccttattcatccagtaactccagccctgtaactttcatgcatgtttctttcccgagcttcagacctgtatgttaaactgcccactgtattatgcccttaatgggaccatcatttatctggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttcttcttttccagattgccttatccccttcctacttgccagtctccgtttccgtggtgtccctcaccatctccctgaagtcctttttccacattgctcctagattggctgtttatagtacacatctgatctgtccctccattctcttaaaatatttcagttgactccctatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaacctttttaagaattatataaatggaatcgtatagtaggtactctttttttttggtctgtttcttcaacataatgcatttgaaattcattcatgttgtggtatgtattaataaatcatttcattaatacattgtacagatatgacagtttagccattacctgctgacagacatttaggctgtttccagtttttgagtattacaaataaggtttctgtgaacagtcacatacaagtctttgcttggatctgtgatttctcttgagaaaatatgtagaggtgaagtgactaggtcacatgctaggaatatttgtgacttttaagaaacactaccaaattgctgtccaaactcgttatgccattttgcattcccatcagcagtgtatgaggctgccactgtagcagcaattaatgtggtcttaaggaagcttaccatgtgctacctactgtagcctcttctcagcaacaatcacaggcttgatggtctagaagtattttttccatacttattcaaataaatgtataattacaaaaataagttggcctatgggccgcataagatcatctcacatttcatggataaactgggaattacaagtgtataattaaattcctgttcatagtaagtatgctataaatggtagatacctgagatgacaaaacttttatcaaacttcatgtatttgaaataataaacagttgttgacatttaattgtatttcacacaggtatttgaaaatatctagcttcaaaagcagtttataaaacatttaaaaattaaaaatacaaatcttcatatatggttttgttatattaactttgagaaattactaaatagcacaaagtaagtcctgtagtaattaacagttgtagaatggattttgtaaaaccataattttatcaatgaaaacgttaaactttatattttgtagttgtttttagggtaaacacatgacacttaaatttttttttttttaacagaacaaaactcctttagttaatgagagcctgaaaaagtttttaaataccaaagacggtaagatgttcagtttgttcttgtttatctatctctgaatttttgaatcttgataccatttgggagaaatcaggaatttcagggctttttttttgtcttcaattgttataggtcctcattttaaaataatattttattgtacaacaatcgtgttgctattacatatttttggatttgggatgttgttgcttaaagccagttttactacaaaaagccaatattaaccattaaaaagcgaaacactgaaatctatgagatgattgtcttacagttagttacagactgatgatcccagtgaaaaaatcaggagattgagattttcattacttaatcatattattcaaagaggaaatttgtaacttaaaaaatttagaaacctttcttccattaatttagtgtatctatttcataatgttaatttaaaaaattcagtttttgaagatttgcttacttacctttttcttgatctttataggtcgtttagtggctagtcttgttgcagaatttcttcagttttttaaccttgactttactttggctgtttttcaacctgaaactagcacagtaagaataatgatttttacatctatcttttgaaacctttgatacaaatgagttaatattaagctgaaagttaatagaatttgacaactgatagttttttacatttagattatttttggtagttgattatctgtttttcttaaaagccatatgagctttcagatagctggcaccagtgttgctgctttgtgttacttgaaagcttgctaataaaagtgttactatagagttaattttgatacgatgttagagtgcacctgttaatggaaacgttgaaggtagaggctctgtaaaagaaataggcataattttttaaaatagacatttcattcattagtaagacagtctctttgagtttaaagatgtctttaaactctgaaaatatcttctttactccttgagaataacttctgctatttttttgtgcacttgtattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaagtaagtagaattctgtgttatctttttctattttaattattggctgcttagtttagccatgcagattagtgcatatatagtaaattaaggttttcatactagaagatattccttaaaaacaaaatgagatgcattcagattgtatcaatgcaaattttaatgaaaattaggaatgtgctgactgtgattctgtggcatatctgttctggtttttgatcctccattcattccatactgtgtatgaagtgggctctaccaggccctaccttggtgttctgaggcttctctgcataagccaacagaagcactcaacttgctattatttttattaaaacatcttatttaaatataaaagggctgatttataggatagttaataaatttttggacttaaaggcctctttaggcttaaaactaagctgttgattttgctttacgctgtttagaaacagttcaaacttacacttttttgatcagtagtacttttcatactcttaacctttttttagaaattgtgctaatgagattaatgatataattttattttcatacattaattttacatgaagatactctgttttatagatacaggtaacatctgtaactgttccagatatttgattaaatgtgagcttttagtcagaaatttataggtaagaatgtggagggctgtataggtttccagttattttctttggtgagtctcagaggatgttttctattagaatttttgaaaattgataaagcttgcctgagtactaattatgtgtaaggcatggtaaatagactttgtgggtactataagataaaatataagaaacttctgtgtctctgaatagcgcagagctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagagcgcaggttgtcacttcagcttgtgcatataatttcattccttcatttatcaatatccagcaagcttttattgtgcgcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttatgcatatttttctgtctagattgatctttcttccttaacataccactagcatggactctggaaccaggttacttgggtgaaaccccagctctgctacattctagctctgtgagcctgcagtcactcagcctccgtgtgcccaggttccttatctgcaacatggagatcacagaagtatcgcgcctacaggtctggagggggtctgaggaagcaagatgtgtgaagctttgagcacagtgcttggcacggaggactctgtgtgttactgtagtaggcatcagtggattcaattaactgcgaattgaaaatattcggataggctgagcgcggtagctcatgcctgtaatcccagcactttgggaggccgaggtgggcgaatcatgaagtcaagagatggagaccatcctggccaacatggtgaaaccccatctctactaaaaatagaaaaattagctgggcgcggtggtgtgtgcctgtagtcccagctacttgggaggctgaggcagaatcacttgaacccagtaggtggcggtggcagtgaggcgaggtcgtgccaccgcactccagcctggcgacagagcgagactccatctcaaaaaaaagaaaaaaagaaaatatttggataaaatacaacaaaagaatgcaaatatagtagaaaactatttatatagcatttacattgtattagatataagttagacacgatttgaagtacataagttatatgcaaatatgtcatttcacataagagacttgagcatccttggattttggtgtccacaggagagtcctacaaccagtcccctgtggatactgagggacgactgtgttagtattactgtttcttgttattgtatggatgactctttaagttcagtgtagtctgcctaagctcagctcagtcctttatcctagctccagactagaatttccagctcttcacaaaacatacctccctggataacccaatagtatattcgaatcctgtgtggaaaaacttactttcttctctttacctctaaaaagtaaaaacataaagacaaaagcaaatcccaccttactccccgcaaataaccctcttcaagttcttcttgctcacttctgtgttttgattgattctattcctgtgactccttggtttcatcccaaggagccacctcttcacatgtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcgtggatttgaggcctcccctgaagtttgccctgactttttcatagctgtgattctgtcaaatagagccaggataggaattctgtatcctcaaaaggtagttgttttactcccccaagttgctgaaccagtaagttgggcatctcatctccattttttgctagttttcccttcctaatatctggatatttaattttaatagtttgtgcatatgtatataaacaaatagataaaatatttaaaatagagacctcaaagatgtatgttttggcccttcattatttattagtgttttctattactttggaagaaaacctgttgtttataatgaaataaaaaattagagcttttattagcttttgactttgactgtagaaaactagctataggttaagctcactgaactaaattactgatgctttttaccaaaactgcattttaaccacctcaagaatcaggttgctgtgccccacccgctttaacctgacttttgtttggttttattggatgctcccaagccgtagataattaaagccctttcttgttttctgagcccctcaatggatcattttcatctccttcagcacctctaccatgtaggtccttatatctgtccaggatcatttcttcctaaaggttctcatgctttcagtctgtcattcactgttgcagaattatttttaaacttcagcccttcctctgttcctttcttctgtacgattgtagtgactgcactgccgactcaggagtcccagattcttcagcccttatgaaatgttctgtgtgatgtggccttaacctgtctttctagccttatgtgttttttttttttttaatgtggaaccttgtacttaagtcagattgaactttggacttactacttgaaagtggcttgtgttttttcgccttctcttatttcgttattctatcctccacttggaattatactctttccccttccccagctgtggaattttgtcagtcaggttttctcctcagctgcaactcttgttcttcctctctccttactggaaactgcatgtaacttagtgcctccttctgtcaaagttgtagtagtgatctgcactggttacacatggaaatttactgaggacaagggctttatcttcatatctcttacacagtctaaggcattgtgatttttttttgtttttttttgagacggagtcttgctctgttgcccaggctggagtgcagcggcaagatctcaactcactgctgcaagctccacctcccaggttcacgacattcttctgcctcagcctcccgagtagctgggactacaggcagccaccaccacacccggctaattttttttatttttttatttttagtagagacggggtttcaccgtgttagccaggatggtctcaatctctgacctcgtgatccacccgccttggcctcccaaattgctgggattacaggtgtgaaccaccgtgcccagctggcatagtgatttttaacatactgttcacagtcagtggaagcctttgaaaatttgaagaggaatacccatttagaagatttgtggaggttagattggtaaaatatggagaagttagcagactagaaagaagtgaaacacataagaaggcaaatctagacaagaatggtagcagtaagaatagaaataagtggacatacaggctagacatggtggctcacacctgtaattccagcactttgggaggccgaggcaggcggatcacttgaggccaggagtttgagaccagcctggccaacctagtgaaaccccgtctctattaaaaatataaaaattaatgttggaatcccagcgctttgggaggccaaggcgggtggatcacctgaggtcaggagtacgagaccagcctggccaacatggtggaactccatctctaccaaaatacaaaaaattggccaggtgcggtggctcaaacctgtaatcccacattgggaggctgaggcgggcggatcatttgagaccagcctggccaccatagtgaaaccctctgtctactaaaaccacaaaaattagctgggcatggtggtgtgcacctgtagtcccagctactcgggagggcgaggcaggagaattgcttgaacccgggaggtggaggttgtggtgagccaagattgcgcctctgcactccacagagcgagactctgtctcaaaaaaaaaaaaaaaaaaaaaaaaaatccaaggaattagctgggcgtggtactcgggaggttgaggcaagagaatcgcttgaacccggcagtcggaggttgcagtaagccaagatctcgccattgcactctaacctggacaacaagaatgaaactccgtctcaaaaaaaaaaaaaaaaaaaagttagttgggtgcggtggtgcattcctataatcccagctacttgagaggctgaggtgggaggatcacttgaatctgggaggcggagattgcagtgagccgagatcgcaccactgcactccagcctgggtaacagagtgagaccctgtttcaaaaaaaagaaaaataaaagaaagaaagaaatgaatagataaagatgaccttttgagaatcaacaagacttggtaaactaatattttggcatggggcaaggtcacagaaggcaataagagaaaagaaaagctctcaaaggccagtttaaggattttagcctagaagataatatcaccaacagaaatagtgggactgaagagggagaactgaagttatgaagaacagcacattttcgtatttaaaaagttacagtcagtcataaagggatttttgtaacaaacagccagtatttactatgtacagtgtcctagagcttgtgctggtagtggatgaattgtaggaagtgattttcatttaagaaacattttaaaaacctcctccttggcattaaccacagtgctcagaaccctgtggtgacagggcactgggcagcagacacagatgactcctgtggaagttgggctagaacaggtacttaccattttggaaaaaaaatgtgtgaaagtagaaaactgggagagtgaactactatttgaaggggtaaagtatttttaatgaaagttgttatttggtattttttcttgagataaaatgaagtagggaaacaaattcaaggagggcaaaaagtagatcttagagaattacaggatattatttgtctggagagtagggagaagggaagtgaggaagtaaatcctggaatggtagacctgggacagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaatattttagggtgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtggactacacaaacctgcagtccatgacaggtcgggtttgtattctttgactgtccctttgattttcatcccataggaatagagtgatgctgtggagtccattccaaaagatgaggtcccatgtgggtttatggtggtggatcgactctcagatacagttgcatctttttaaatagatgaacttccaggacgtagtgattatactacacgatacctttcttttttaaatgtctaggcacagaacattgctgaacgattgctgttattttttgcttgttctttgatgttgttgctcctttttattgtttaagtttggaaaactaaggaattttatacttcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaataaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacccaacctttaggaaccagctttgtgtgctcctgagaaaggtcagatgaggtcaggacaagtcttcaaggaagttgcctaggaactcaagtgaggcttatttagaatgctgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggctggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcgagaccatcctggccaacatggtgaaaccccgcctctactaaaatacaaaaattagccggccgtggtggtgtgcgcctgtaatcccagctacttgggaggctgaggcaggagaatcgctttaacccgggaagcggaggttgcagtgagctgaaatcgtgccattgcactccagcatgggtgacagagtgagactctgtctaaaaaaacaaaaaagtaacgatggcatgaaataaaaagtaaatttcactgtcacgtttttatccaggtgaaaatcatactgttgaatcttaaaaccatgctctcagttttactttgaaaattcctgttgtgttggcaattagagttgaaaatacgtatttttcttttgaatggatgattatatacatattagtaacattgtgatttttatttgaggaaaatagaacatcaaactatttttttgaatacgtacctattgataaattaaaaattaaacgtatttcctccaagatgtttttgtgttctgtcatttttcagacaattgcacatttgtgatcctttattcagtgcccctgctcacagtagactgctgggggccagtgctgcatactaccaaggccttggctgctttttcatcctctcctaaagatcacaaaaattgactaatccagtagattagctgcttatgaaatttaaatattagaagttttagaaacattatcagtacagtttttacatgtacttaggataagacaaaatatttaattttcagttctgtgagattcattagtcctatgctgaactttggttatgtatagattttttcactaggttgaaaatcttcaaacttaaagctttttaaaaattccacctgttgtgttagatggctttagttctaggagtttcaaaggtaaattcctattactgtattctctttctgttcacactgttctttatgcgttattaaacaagaagttgctttaaaataatgatttagtaagttttttttaacatttacatagtgaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatctatatttttttgtttttaatatttagaattagttgctctttatcattatattaaatgtaatatgaaagatcatcctttcttcttacaaatagttttcaggtgtctgtttctttttagagacaaggtctcactctgtcacctaggctggagtgcagtggtgtgatcatggctcacaccacttgtcctcctggggtcaagtgcccacttcagcctcttgggtagctaggacaacaggtgcatgccagcacagctggctaattttttaaaaaatgttttcatgtagaggcaggggtctcactatggttgtccattctgatcctcaactgtggggctcaagtgatcctcctgcctcggcctcccaaagtgctgggattacaggcatgagccaccgtgcctggcccagttttcaggtattttaaaactaacatgtattgagatgctttttcacattacgtgtaggttttggggcatatgtttttgtatctttggcagtcacctgaggattttccaaaccaggcgttaccattccctgtcacactctcacaccatcctgaatgaatggatacatggatgcatgaatgttcccacacttagccctgtagtaaaattacttctctaaataattcattagtaagtcatggatcagaaactgtcgttggcagggagagaggtggggggcagaggcatgggtgaagagaattttaaatacagtcagcctcatatctggaggtttcatatgcattgctttcacacctgcagattcagtcgtatgtaaatggaaaaatggttataaaaaataataatacaaattttatttattatttatttatttatttttttttttatttttttgagatggagtctctctctgtcgcccaggctggagtgcagtggcacgatctcggctcactgcaagctccgcctcccgggttcacgggaggctcctgcctcagcctcctgagtagctgggattacaggcgcccaccaccaagcccggctaattttttgtatttttagtagagacggggtttcactgtgttagctaggatggtcttgatctcctgacctcgtgatccacctgccttgggctcccaaagtgctgggattacaggtgtgagccaccgcgcctggccaataatgatacaaattttaaaataatggtatacaactgtctacatagcattacatttattaggtattacaagtaatctagagatgattcaaagcatatgggaggatgtgtgtaggctatgtgcaaatactacagcattttatacgagggacttgagcatcctcggactttggtgtctgcaggtgtcctgggtactgagggacaactgtattgcatgaattttttgaatacttttgcaaaacaatagtatttctttgatatttttcctacatgaacagtttggaaaaaaattcttttttttttttttcaggttcttaagtcagtctgatacaattcagtttttgactactgaaaaattaaggtttctcattgtgaaacttctctagtgctgactttttgttaatctagaaatgattggcttctttattatatgagtgtactattggataatttaaatatatactaaagctttcttatggctgcactataatttcccatagagcttattattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactccagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacacccagctaatttttgtatttttagtagagacggggttccactatgttggccaggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaatgttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacacatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaggagcgtcttgttcggtaatgtctaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccatgtatggtggctcacggctcacgcctgtaatcccagcactttgggaggccgaggcgggtggatcacttgaggtcagaagttcgagaccagtgtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaaaaaaagaaaaaaaaatggagttaataattttggactacattccagattccttgtttcagttgagtgctttttctattattccacgggtattttacacaatactgctctctttagtatgcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaagcttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatatgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacacacaaaggttgcacacacacaggtttgattatgctcatgagacttcttttattattgaaaatatcttaaagttttatctcaccaaggaggccttttctctttccctctctttctagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgtgagtaaatggtttttgagctatgagactaggggtttaaaaataagataaatgttttcattttatagttaaaaaataatgaactatggaaggtttataattattggatccataaatctgactatgcgttgttaatgcctttcatgttgtaaaacaatcccagattttagaaaaacctagacatgatttattccaacaagtaagtgtagattgagtgtcagccacttgccagggctgttccagggtggggtgcagcaatgatagaagagggaagactcctgccctcaggaagctcatgctctggtgacagagtcaggcaatgagggttatgctgcagtgtgtggggtgatgagagcagagcagtgatgggagcccgagtgtgtggtcagggcaggtgcatgtcagctgtccaaattggagggggcctcacttggaggtgcccagtgagcaaagagctagaggaggtaagggagttgccgtgggttgatggagctttggggagaggaaacagacagcagggaggcgagttgggggtagcagagagagcaagatggggatcggatgaggtggactcagagatgaggagctggacggcttttctttgagactggaagccctgaggatcttgatctggcgtacattacagaaggatcctgaggttgctggggaaggttggtcttagagtttccagttaggaggccgttaatgatggaaaaggatttgccagtaagtgctagagaaaagtaatatacagagtggcatcatggtttttagcctgcaaaactagaaggttggaaacacgttagatgaagagtggcaagagcaagagtggattacacagacaggtggcatgacagcctggaggcccctgttgctgtgctaagttagagaagattgctagtggaaatccaaagtaggctattgagtgtatgcgttgggattgatggagaggtctgagctggagatgtaaattaggagtcatcagtttgtagataatgtggggtgtgggagactacagaggatcaccaaggaagcaggtcctgcgcaccttgaggccagagcagggagctagaagcagcagaggagatggaaccaggagagtggtgtctgtggaggtggcggtagggaggagtagctgtatgatgccgttggatttagccatctggaggtcagtgatgaccttgacacagttttgttggaatgggggtgcgaggcaggttagagaattagagtgcattcaagacagacaggaaaggattgtagatgaaaaatagttttctgatgagttgtaaaagtgtgcagaggagcagggtggtggctggaggggcaggatttagggctgaaaaacgtgtttaggtgggagaaataacagcatgtatgctgacgagagctgttcagctttaaagatggaagaattaatgatgtaagggagtgagaggagaactggagggctgcgcagcagtggaatcccatgcaggggcttgtgtttgctggaaaagtggagagcgtgtgggtctcattgtaggcagggggtggatatgatggtggcacctgtgcaagctgtcacctgagttcatagttgagtgaggatggaggacggaggttggagataagaggagagtggagaaagcatgaaatctttctataagaaagtaaggcgagaaggcactgtggaaacccggagggttgttgggcaattttaaaggtccccttgaggttagtggtcatgactttaaggggagttcatcagcatggctgttagtggcttctgtaagcaatattaaatctgagaggtggcacttatttgctagtaaactcctgtattgtcccttggctgcatgtctgggtaatggaaaagggcttccgaaaaaaatcacagtgaagaggtcaatttagtttatatcaaacagaattctaaagagaggtgagctgatttcttacgccctggctgtgccgattgtggttgatctgtagtttgcactcccttggtgtactttatggttttgaatctttaaagtgtatattcttgatttccagccaccacacgtataaaatatctttaagttgcttttgtttctgtggcagaataaaagtgtttagtggcagaacataagagcaccgattaactgtccttgtttcttgttaggaggaaggaacctaggaagcaagcaggaagtctggcctcgctctcggatgcaccccccttaaaaagtggactcagctccctggcgggagccccttctttaaaagactctgagagtaagtgcccaaagatgtggacttcaatactcgggatattttttctctaattaaatactatgtgattattgttgattttttttcccaggaaaatcactaaaataacctatcattttatcactcagagatatttcctgttaatattttgttgtgttttgttacttctaaggtggtcctattttatatgttgttttgtattctggcccttcctatacctatataccatcggaatacttttgggaagttgactttttagctgatttttattatctatagaaataaaatttttaaatcatctctccttttttggacatttacaatgacttgagttggatttgctttcaattaatttttaaaaatttggtgataccacagtaagtatcataaaatgttaaataaaaaattattctgcagatcattttcaagaacagtgacctgacatgtcatcgtaaatgcagcagagctaaagagcactggttacacatggaatagtctagctctggcaccagttactttcccacctctccccacacacagtgataggaatttaaaaagcatagccctgaacatgtaggatgggcagaggtcctttggaaaccgtatcatagtaaatgttgtatttaattagcgtagtgtttcagagcacgtgtacctcttttgagaaagtttcctaaagtagattcactaagaatttgcagtatgcgttttgcataattgtccagtatttccgaatctttttgtattgcttgatatactgtgggacttcctagggcacataagagagccggcctgttgcttctcttaaaccagccatgtatttataatgtccgcatcccttcccatttgcttctttcccgtggttactgccacctttaagaaaggaatccaggacatcatgaacatgtcattctgacattgattagagaatgatcatttagagaggacgttgagaacaaaggactaaaaaaccagtgaggatgtcactttagtaagtgaaatagcagttgcactgaagaaaaatttagaaattcaaaggaaaaataagactcatgaaaataattaacagtctatgaattcatacctaacagggctgtttatggaaagtgatgtcttataatgaggcaaaaaatggtttttggtggttgtgttccaataaagtagtattgtttatggtttaaaaagggatgtagctgggtgcagtggctcacgcctgtaataccagcactttgggaggccgaggtgggtggatcacgaggtcaggagttcgagaccagcctatccaacatagggaaaccctgtctctactaaaaatacaaaaattagctgggtgtggtagcacatgcctgtagtcccagctactcgggaggctgaggcgggagaatcgcttgaacccagaaggcagaggttgcagtgagctgagaccgcgccattgcactccagcctgagtgacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgctgatcgttttaaagtgattatttttagggtaaggctgtaaaagaagtgactccgtctgcctacgctgagcaccttcctgctgctgctcattcagcaggtgtttgaatggcttttatgtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtacatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcgatgtgaacattaccgagccctgggccatatgttgagagcacatttctcattcagtgttctgttctgtgcaagactgtagcagtgtgacaggcatactttaggcaaactcatttatgtaaaggcaaacttggtgacctgaaggaaacggtgcagccaggttctcaatggccacttcctatgctctctgtggatgtgatgggatcccttcctggtctgtaatcactcacatggaagcattggaagagcttcacaggcaggttagggagaaagaaaggtgtgtccccatttgcttttaaaacccagccctgtccaaggggcagctccgagaatgcccttccctcttctggagagacattctggatagtgcaaagaacttgggcttggagttggatagaagtgacatctcagatgtggcactgattgatgggtagcgtagggagataaactaaactgctatttcctcatctgttaagtggaactaataacatctgccttgttttaaagagtaaataggatttaaatatctcttcatatgtaaattaaagtacagtggctggcatggtaggtgcctagtaaatgttagttttctttttacgttacttttccccccatttgcagaagaataaatgttccctgagctgcccggattcttgttccgcacagtgccctggagtcctggtaactgagttgctggttgtgctgccatctgctctttgtgcgtcctggttgctggctggccagctaggtgggcctgcctcctttccctcccttgtgcttttcctgtcagctgtggtcatggttgccattagatgttcttttccactaaatctcagtggctaactgccaccagagactttactcctgacctctgcaccgtgatggccgccttgtcccctttgtgttctgtttttttcacttttgtggtgtttcactctgttgccaaaccttttagcttttttctctgactgctctattctcttaccaaagcgagggttttccctcctgtttctgagtggggagctgccgagaattgtcatcctcaggagggaatgtcgttgctggggctgcagagttgctgggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcgttttgcaacaatgttgttttctgtttgggttgtttacattttaaatatacagtactctaggtattttgagtaatatgtagacagatgttagtggaccagcctaggagaataatgatgttagtggtaagtgcctggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaaaggtgcccaaaaggagtgtttatagataggtactttgcatatttaaagcaagagttgctaagctttttccgtaaagggccaaatagtctatattttagggtttgtggatggcatgtactgtctctcacatagtctttgtgtgtttttttgtttttttgttttttaacaatctttaaaaatgtaaaagccattcttagttcacaggctgaacaaaagcaggtcatcagccagaggcaagaatgaaagtaaggaaagcagaaggctgtcaggaagtccgggccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtccccactcagaaagttctggattttattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaactacaaagaaccttcttaagcatgggggagattataaagaaccttcttaagggtgggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaatccacattgcagccacagccgtcctcgctgtctcagctcagtgtccacctctgctctcctcactggccttcacacataggaacactacaatgggtccttggaggctgacattttagtagctgccactcctggttttacttagcgcttgcaaaccagccacatatgtagtttgtttaatcagatttccacttctccttctcggccctgacagtgcctggtttctggcaagcacttgcagccctttaacctttgaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacacctgccttgacccaagccttttacccctgttctctttggcctggactttctgacagccttctgctttccttactttcattgttgcctcctgtacacatatttcttctggcggtggtacgattatctctgggaaaacagaagtgaggtagtgctaccctgcactttttcactcctgtcttcccccaccccaccccatccctttgtacaaagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttggcctcccaagtagctggattacagatgtgcgtcactgctctgggctgcactggtggtttttcaaaccaccgcaccctcccccacctcagggcctttcacatgtttcctcttggaacacactgtccccagtaatttgtacctctgcaacctaggtttccactcagttgctaccttggagttcttcccaattgcactagcagtatttggtttgttccactgttcctcttcactagagtgtttgctccctgagatcagagataccatcttagtcattgctatacctctaggggacctagtcatcactcagctggttgataaattaatcatatgatttggctgtaagagaattacattgtctaactgtctggacagagcttgaatcccctcagcagtctgaccgatttagagacagtccagccttatctgagggaagatcgaggacaaggcccgcagggtctttgaacggctctctgtcatgccaggtcttctttttgtgatctgcatcttctgcatgtggctgtacatgcttcctgggtctttcataggccatccattcacattttaagttggctctcatgtgcctccaagtctgctttgaggctgacaactctttttcctcatctagccctcagaagtcctgggagggaagggctgctgatttgcaaatttgtcctttatagccttaagttgatctgaaggtgccccctctgtcagaggcttgtggtgcactttgagaaactggtaacactgcctcactattcaccatcccaccttcattcagttgccttttattaagatcttactgtggaccaaggtctctgttaagcacatcatgtacctgaatccttatgttaactctgattggtgtggctttggctgtacgtcagagcagaggacatggccaagaaagggcacctcacattcccaggtcacagagctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttctagtctgggactttttaaatgatgcaatataattaattttttttaaggaaatgtgtgtttaatggtaggtaaattgtgacgcacattagatataacatatcttttcttaaacttatcaggaactggagaagatgatgactatgttgatgattttaataggtaagaaaaactattgggcaaatatataaatatatacgttatttgtaaacaatttccgaacacagacaagacaaaattacatttggtgcttattttaatgtatttgattctgttgttcatattgattgaagatgaagaaaagatagttaatccaaaattaaatatttgattttagagcatgtttttgattttacattagaatatagacagtcacattatgttcaggaaacttggtaagaagaagagaaacaattgaagaattaactgagaagtcatttagaagcagttcagttgccgtgtcataagtgctgattttctcttccttccatacctttttgtggcgggaattgtctcaaaattgacctaaaataattatgctctcaaattagttttttgattcagatcacatttcctaatatgtggatatgtggtctgccctaataagattgccattctctttttttttttttttttttttttttttgagacagagtctcactctgttgcccacgctggagtgcagtggtgcgatctgggctcactgcaacctccttctcccgggttcaagccattctcctgcctcagcttcccatgtagctgggattataggtgcgtgccactacgcctggctaatttttgtatttttggtagagacagggttttgtcgtgttggccaggctggtctcgaactcctgacctcgtgatccacccacctgggcctcccaaagtgctgggattacagacgagaaccaccatgccctgtcgattcctttcttatacacagaaagataatatgtaatgtagaagtaatatttgttgtggatatgattcgaaattttaaattagatgcctgagaattttatttaattgacaggttatctttccaattggaagtctgtatttttttttataatttattatacagtttttgagaaagagcatgatgtagtagatgaaattgtaaaaatctgggtttgtttctttcttgctattgtgaccaaagtcactgctttgaacctttgtctcctcatctgttacattgacttgactgctgctgcccttgctacattattttaagggtcaagcaagacaatatgtatgaaattaattatagttaatattatattttacttaaaggattaaaagaaatatctgaatgtttaaagaatagtaatctctttaaatgtttattttcagagttcttatttttttttccccttctgaaattagtaccagccatcgctcagagaaaagtgagataagtattggtgaagagatagaagaagacctttctgtggaaatagatgacatcaataccagtgataaggtatggtgttctgcatttcccatagagtgctttttttttttaacctatttgtcgatttactgtaaagcttcaaaattcatactaattagtagaaaaacagttgaaaattatgaaaagtcatgacagagacctggctcgagtttataaagaatgtctttgatgaatgtgtaagattggttttggttgtcacttcctttggtatgcaagtctcgctgctgaaatgcctgaggattattcctggggcactgggattgctgtggattaagagggatcagggtgggtcaggcttagtgagaattgaccacctggtgccataggtggaagtcagtatagggtactgtgatcacaggaggaagctgagcctggagtgcagagagtgtggtcatcttggccagttgtgacatctgaacaggcaagccagactgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacatggtgggattctccaagcgctgtgattgtcacacagggagaaggcctttgagagaggtagcgtttacaatgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggattctttaaatatgagggagaggactcgaagaaatgactgttaaactaggatttgtgaaatgacgtgggttgaagaggaggtgtggcatccctttgccattgggggccttggatggcgtccaggagtctgggctttgttagactgcttctcactgggtcctactcactgggtttggcacatcaatgttcctaggagttttcacttaaaagcttaaatttagataattttgccatttacatagattggactttgacagtcactgtacttcatcaggaagcattttctaaagccttctgtgtagagaattgctactgggcacctggggaacacaaaagcatttgtattctttgcagtaagaatacagcagacaatctggtcacctttcagccaaggtgaccaaaaccagtgtccattaagcacctactatttagagagcacagggctggggatgtgggggtgtgaggaaggagatagcccagtggaatgggcaagttctgtaagttcatcacatctgggtttgagttctggagctgctacttaccactcacaaatttggccaagttatttaacttttttttgttttttttttttttagacagagtcttgctctgttgcccaggctggagtgcagtggcgctatctcagctcactgcaagctccgcctcccgggttcatgccattctgctgcctcagcctcccgcgtagctgggactacaggcgcctgccaccacgcccagctgattttttgtatttttttatagagacaggacttcaccatgttagccaggatgatcttgatctcctgacctcgtgctctgcctgcctcggcctcccaaagtgctgggattacaggcgtgagccaccgcgcccagcaagttatttaacttttggggccttgggtctcacatctattttgcaagagagatggtggtagtgaaaattagagataagcgtgtaaagcatatagctcagtgcttagcagaacaggcattcaataaatggtatctaatactattattcattgtagtcacaatagacatttctgtcgtaggcacagatatagacttcttccctcaaatttatgcaggatcagagagagaaaagccatgtacacaaacataggaaaatcaagataaaaagtgacaggtgccataaaatgccagtcattcatgggccatgaaaattcagaagcaggaactaatatttgaccgggattttgaaagatgactctgacttggttctgcgagggctgaggaggaacatggtaagctccatgagaacagaagggagatcccgggacatgtcagtgctgccctgattccagagcttcactggagggtgctgtgtgaagagacagaatgttgggaggagcagggttgttagaaggtgactttgaaccagaaatgacagaggatgaactaggagcagaggccctggggagggtagtctctgcacgggagccagcacgagcaaagacataggtagatgttggaggaagagggccacacgttcctaagggacagaacataagtgtgcatcccaggtttctgttaatgcatagcaatctaattcagcaaacgtgaacatttacacttcataaaacttttcaaaatcttacaagttcccgtcgatttgtatgaagcttgctatcacagggatcctttgtttccctttcaagactcaaaatgtatgttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctgagattacaggcgtgagtcactgtacccggcggaaaggctttattaaatagccatttatttctagttagcttttgttcattcagttttctttcttggtaactactttaaatgaaactgttcttcttggaagtttctggttattattgtggtcttttctttgccttaaagcaaaactaaattaatgatctccaataactgaattatctagattaagatcgttttcagtccacgatttttcctgtattcactcttgtctgtagtttagcatttgtattaatataacactcaattactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacttaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatatagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaatatttcctttctccattatcatgagttgtttatacaaatgaatagatataagttggttaataggttaactttctagtttacaagtagtttaaacagaagtagaaatgagtcgtttcttacaacactttgtgaacccggggctgggagtctgagactccatgggctgtcctgtctgcccttctgttttcacttcatgatctggcttcaggtggcacagtgttaaagtgtgtcacaccatgtcgagtttgatgttagaaacttaacgttctataccgtcatatgaaaacataagaagggatcgtttccaaattatacattttaatgaattttcgtgaaatttaacgtgggtaaattatggttttagagttagcaattcatagagtgatacttcctgtgaacagaatcatacattgggactatgctcaggtaaagaagtttaatacagtttttcactaatttgtttcttagattaaattggaataatggctaagatgtgttttattttaaattttcacttgaaatatttgagaataatcataaaacattgggctctaaagattgtactaacttagtagacatgattttaggcaaatcgcttctcaacacagctttaaatatgagttggtttatgaagtataaagtaatactttacagcaacagtttttttaatttttagttttttatttcttatttccataggttttgggggaacaggtggtgtttggttgcatgaatgagttctttagtggtgatttgtgagattttggtgcacccatcaccctagcagtacacaccgggcccaatttgagccttttatccctcaccctcctctcattctttctctggagtccccaaagtccattgtatcattcttatgccattgcatcctcataacttagctcctgcttattaatgggaagatgtgatgtttggttttccattcctgagttacttcacttagaataatggtctccagttccatccaggttgctgcaaattccattattttgttactttttttttttgagtcggagtctcgctctgtcacccaagctggagtgcagtggtgcaatttcggctcactccaacctctgcctcctgggttcaagcgattctcccgcctcagcctcccaagtagctgggactacaggcacccgctatattgtctggctaatttttgtatttttgtagagacagggtttcaccatgttggccaggctggtcttgaactcctgacctcaggtgatccgcctgcctcagcttcccaaagggttgggattgcaggcatgagccactgcgcctggcctatttgttcctttttatggctgagtagtattccatggtatgtatataccacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcaccgacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagcagtggttatgagttttaattcatagaattgtc

SEQ ID NO: 9025 - DNA, 455 bp, Homo sapiens
gggggcctcagaacgttatttccgggtgacaacctgcagggccttccgcccctcgcgacctctcgggagtcccttccccggcgcccccccggggctgcaggggctgcaggttcggtctcggggcctccttaccgcagtccgcccggctttaggctagtgggctttaactacgtcgataatatgactccggcgatcttgtgcggcgatgggatgcggccgtgggcggtggagtccaggcggagtccgctctccacacgcgagggcgcctcctcctcaccgctcgccggcttcaaagctcgcgcctcaggcgacggcagccaacgggttgccggctggaggccccgccgacgccccgccccttgcgtgcccacccgcgccccgcagccccgcccccagcgccgaccctaagtttcggcgctcagtggtccggcgctccccaaggctcggtgtccagc

SEQ ID NO: 9026 - DNA, 577 bp, Homo sapiens
ctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattac

SEQ ID NO: 9027 - DNA, 22798 bp, Homo sapiens
atgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagtgagtgattcggccctgggcgggtgggctggtcttctgccctgcccctgggtacagccctcggtgctctattcccgttccagtctgttgcgagttcaggtctattcaggattctggattacatcctaacgtgggcgagtttctgttgaacgtgattgcacgtatcaagatgtgtgctcttagatttgttttcaatccagataatttcagaaatacattgtttagtacctcaattggaagtctgaatttttttctgatttcacaatgaactgtggaagtggatcgcttgttttactacacctgagcaaagcacaacagaaatttaatttatcgcgtttattacttatttgtaggatcgaagcagctcaatgtccagatgttgtggtagctcaaattgacccaaagaagttgaaaaggaagcaaagtgtgaatatttctgtgagttttattaaccgtctggagattacccccaaccccccaattaaaagactaacgctcttcctatagtatctgacagcatcaattatgacgtaagatttgactactccgtgcaaagttagacattcgcttgtactttttccttcagaaagacaattggcatttactgcctctaaagaggctttctgtaactctagcctttgtggagtgttgcccatcttacttcaggacattatccagtcctttcaaaggagtctttaaatgggttacttatgttatcttttattttttgcttgtttgtttgtttatagagagggagtctctgttgccagctggtctggaactcctggcctcaagtgatcctccctcctctgccacccaaagcgttgggatcacaggcgtgagccacctcacctggcccctttattttttaaggaactttttccagttattggattggtgtttaatcttagtgtgctttgcatgttctgaatttgaccaagtttcactttttttaagaatagaaacccagatgtcttacactttttttttttttttttttgagacagtttcactcttgttgcccaggctgcagtgcagtggtgcgatctcagctcactgcaacctctgccttccggtttcaagcgattaccgtgcctcagcctcccgagtagctgggattacaggcgcccaccaccacacccggctaatttttgtatttttagtagagacggggtttcaccatgttgtccagtctggtcttgaactcctgacctcgtgatgcgcccacctctgcctcccaaactgctgggattacaggtgtgagccaccatacccggccttacacttttatagctacttgcacactctggacattttcatttatttatttatccagcacatctttaattaagcaactaggttgtgccgggcattgggaattcaacagagggtaagacaaaaaaggttcctacccttgtagagtttacataccctcctgaggaagacagagagtaaacaagcaaacaaataattacatattgtgattattgctatgaagaaaataagcatgtataataatcaataaatgacagaactactgtagaggaatcatagaagggctctctttttcccccttttttttttgcgtctcaatttttcgcccaggctggagtgcagtggcacaatctcagctcatcacaacctctgcctctcaggttcaagagcttctcttgcctcagccccctgagtagctaggattacaggcgtgtgccaccacacctgactaatttttgtatttttagtagagacgtggttttaccatgttggccaggctggtctcaaactcctgacctgaagtgatctgcctgcctctgcctcctaaagtgctgggattacagatgtgagccaccacgcctggccagcaaaggtctctctaaggaggtgctatttaacctaagctcaaaggagggtggcattttattttatttctttttcttttttttttttttttgagatggagtctcagagtctcgctctgtcgcccaggctggagtgcagtggcgcgatctcggctcactgcaacctctgcctcccgggttcacaccattctcctgcctcagcctcccgagtagctgggactacaggcgcctgggagagtggcattttaaatagttgatagtaatttccttttcatgctcaaagtagtttctctgatacttgtaatcaggaaattttaattcagacactgtaatttttcctataattcctcttcagggttttttagttgatggacatttaatggaacagaatgtcttaatatacctaatttgatggattgattgattgattgattgagacagggtctcgctttgttgcacaggccagagtacagtgccacgatcatagctcactgcagcctcgagttcttgggctcaagccatcctcccacctcagtctccccagtagctgagatgacaagcatgtgccaccgtgcccagctaattgtattttttgtagcgacggggtcttgatatgttgctcaggctgtatgtgctcttttagaaaacagaagtatggctgggcttagtggctcacacctgtaatcccagcactttgggaggccaagtcaggcggatcacctgaggtggggagttcaagaccagcccgaccaacatggagaaaccccatctctactaaaaatacaaaattagccgggtgtggtggcacatgcctgtaatcccagctactcgggaggctgaggcaggagaattgcttgaacccgggagacggagattgcagtgagctgagatggccattgcactccagcctgagcaacaggagcgaaactccgtctcaaaaaaaaaaaaaaagaaaacagaagtagacaatttaaagttaagcgtctttaagtacattttgcccataccaaagttcttatttttaattttattgatacataataatcataatttcatgctttatcacgcaggcacaataataattgtacatatttatggagtatatgtgatattttgatacatgcatacaatgtataataatcagtaattaggatagccatcacctcatttatcatttctttcttttgggaacattcaaatcttctagctgttttgaaatatacaataaattattgttaactgtagtcactctactgtgctattgaatgctagaactcattccttctaactgtatttcataccagaattctttatttgtggtatatctctctttttgtttctgttttgctattctagaaaggcaggtagggctagatcatattctccaggctcatgtcatttagatttcatagaaactccaactataaacctttccagatttctctgattaaggtgactaaggctctttccctaatatttttaactgagatataaataataaagtgaaatgcctacttttttacatctgcaaaaatattttattttcttgtataatctttattttattatacactttatcttggttttacttttgctttgcagaggcatgagattctagttttgacactaatgttgatcctaatatttgtgaacttgatctctagctttcaggatgccaacccgcccctgaaggttattccccaacacttcaatggcaacagcaacaagtggcacagttttcaactgttcgacaggtaagtgtcatatttaatctaattaagcccctgttggatttatttctgttcttagactgtagctggaaaaataaaatttatgatcctaaagtatacagaatattcatgaattaattaccaaattatttttataatcattagacatgatacagtttgaaatattttctaagttttgtttatttttatttgtttgtttatttatttcaatagttttggggaacaggtggtttttggttacatggataagttctttagtggtgatttctgagattttggtgcacttgtcacccaagtagtgtactctgtacccaatacatggtcttttacatctcaccccctcccacctttcccatttttcaagttttagatggttacaattttgtgcagaaactgatttcagttatccattttttgaagagtaccatctaatgtctaagttttcttcctttagaatgtgaacaaacatagaagtcactggaaatcacaacagttggatagtaatgtgacaatggtatgtaagtttctcagttttaagatgtacaatgtatacctgattgaaagagtctatatttacttccagtcgttaaagattcacttgcctagtcagtgttactttcattctcttcaatataccattaatagtaacaattcattacattagtagcctggaaagtatagattttcatgacaaattttttttttttttttttttgagacagggtcttgctctgtctcccaggctagagtgcagtcatggctcactgcagccttgacctcctgggctcaagtgatcctcccaccaccgccttccaagtagctcgaacttaaggcatataccaccatgcccagctaattgttaaaattttttgtagagacaaggtctccctgtgttacccaggctggtctcttactcctgggctcaagtgatcctcctgccctagcctccccgagtgctggattacaggcatgagctactgtacccagcctttcatgtcaattttaattcacaatatcttgggggactttggataggtgactgtgaaacttccacaagtttttaaggattcttctagacatttactttctaggaaataaatacattttcaatatttacaaaaaaaattgaataaagccttaatggattttcctgatgaggtgatggtgccatgcagtaaactcacatgtttacagaacttgtgaatggattctgcttctgcttaatgtgatgagtctgtgtcacaattccagtgacatataagtgaaacctgtcatgtatattgtcatgcatatgtcctatattttatcagtttagatataactttaagccctttagtagatatatcaggactaccaaatgaaaaaaggagttggaaagatgatacattgtctcaggacagtagtttttaaccttttaggggacttcatattctttcgtagaatctaatgaaagctatttatcttcagagggaaaaaaaatgcacctatgcacaacattttagtttcaggtagttcatagattttagattttagaagcttcctttaggcagtgcttcctgatatcttttacatggtgacacattagaataaatgactgcttgcatattcttcctgaaaccagccgaaagctgagagattcagtatatggcatctctgtatgcttctgcataccatttggaagctctgctccaggaaaagcgtgaagggaagtaacttatcacttgccaatggtcatttaacttgtaaaaggtatagctagtccttctatcaaagaagcatgcgcacataaacacacaaaaggtatgcttaaggttcaaacccaagttggtctgtctctaaagcctgtgtgcctttgactatgcaatggtgccttcctagtaccaaggatgtatgtatgtagtagggacagggctaggtaggtaaatatattttttttcttacttagcggaaggccttttgggtgcatgcccactaactaaaaaagaagccacatcagtaacattatgacttgataaaattttgtcaaaaatggaaatgacctaacataattgattcaataaactatggtccatcagaacagtggaatattatgtagcaattttaagtgtttgtcatggcaaatgcaaacatcatataagtaataaaatgaaaatgttttaaagtacactctgagccaggcacagtggctcatgcctataatcccagcactttgggaggctgaggtgggcagatcacctgagctcaggagttcgagaccagcctgggcaacatggcaaaaccctgtctctatttaaattatttaaaaaataaagtacactgtgatggcaactgtgtgaaaacataaacatttgtttattaattgatccaataatttaagcatgtgctatatttaataatcaggatattcagtactaactgaaacagaaacagcttctgacctaatagagtgttaggaaaaggtagataaccttattccaagacaatagggtttaactttgtagtggtctcatgttcatcgtgaggttttattttattttattttattttatttatttttttgagatggagttttgctcttgttgcccagtctggagtgcagtggcacaatcttggctcactgcaacctctgtctcttggattcaagcaattctcctgcctcagcctcccaagtagctgggattacaggtgcctgccaccacacccagctaatttttgtatttttagtagagacggggtttcaccatatttccaggctagtctcgaactcctgacctcaggtgattcatcctaaggatttaatgaaagctacttatccctagggggaaaatgcacctatgcaaagtaatatacaaggtgatatgtacaaacaaaggttattttgttaaggaggttatattgagctgaatgcttctcccaaatagtcctgcgtcctgctttttctgtctggcagcatgagtagatctgtttcttctttgactggacaacccttcaaatatgtgaaatatgtaatcatgtctctttacatgggataaatatccttcattctattaagtgttcttggtgcattttttcccccatacttatttctgtctttatcatcctcttttggacacaccattgtctgtcagtgtccactaaagtcttgtccaaactaaacacatcttggctgggcacagtggctcacacttgtaatcccagcactttgggaagccaaagcagaagaattgcttgaggccaggagtttgagaccagcctgggcaacatagtgagacaactatctctacaaaaaaaatttaaaaattatcaggcatggtggcacatgcctgtagtcccagctactcaagaggctgaggtggcagaattatttgagcccgagattcaggctgcaatgaactgtaatcacacctctgcactccaacttgggcgacagagcaagaccctgtctcaaaaaatgtaataataaggaaaaacaacatgtcccacatattgtgtagccacttaggcactatgtttgtcagggctgccataacagactaggtggattaaacaacagaaatgtatttattttctcagtcttgaaggctgaaagtcaaagaacaaggtggcagcaaggttggtctctttttgtttgtttgtttgttttttgaggcagagtttcgctcttgttgcccaggctagagtgcaatgacgcaatctctgctcactgcagcctccgcctcccaggctcgagtgattctcctgcctcagcctctgggtagctgggattacaggtgtgcaccaccacatccggctaattttttttttttttgtatttttagtagaggtggggttttgccatgttggccaggctggtcttgaactcctgacttcatgtgatcgcctgcctcggcctcccaaagtgctgggattacaggcgtgaaccaccgcacccggcctaaggttggtctcttctgaggcttttctccttggcttgcatagggccaccttctccctgttttctcacgtggtctttcctctgtgtgtgggagtccctggtgtctctttgtgaatccaaatttcctcttataaggacactagtaagattggattacggctcaccctaatggcctcaatttaaattaatcacttctttaaaggccctgtctccaaatacagtcacattctgaggtactggagtttaaggttttaacatacaaatttgggggcagagattctccccataactggctccgtatctttgggttgcggtaatgggaatatggaaggacttaacttctttttttttactgttcagtgtaaaaattaatacacaggaataaatcagtttttttttttttcttttagccaaaatctgaagatgaagaaggctggaagaaattttgtctgggtgaaaagttatgtgctgacggggctgttggaccagccacaaatgaaagtcctggaatagattatgtacaagtaagggctgtgtggataaacagaacaaaaagcattttaattttggtgcaccacttaatataaggggtcagcaaactctaccctgggccaagtccagttcatggccttttttatatccatgagctaaggattgtttttaggttttgaaagagtaaaaaagaaacaaataatatgtggctgagactttatgtggcctgcaaagcctaaaatatttgctgtctgactcttgatagaaaatgtttgccaacccagacttagtttattagctcttcaacctaacaaaacagcttagtttctgaaacaatttactgtgactttttttagtttggcttcatatcccttatgtttggcttggtaatcattttatgagttggataagattcatagtttttttaaatgatgaggcatcaggcaaacagtgttatgagtagccagggaaaaaatggaaatcgacacaattagatgctttaaaatgcataatcacatctatcacttcatgggcctgtaaaaaataaatcacatattctaaagatgaaatgttgaggatatctttaaaattcatgtggctgtaatcataagttatgtagacaactccttgtccttcaggatttacctgcccccaagtttgcaggtgttccttgagaatccagtgcatgcctctgcattagcgcttactccctatagcatgtagttcttttcagttcaacaggtatttattatttgctatatggtgccacattgtgtttttcacatttaaaactaatttttcctaaaaatgtaaaaagccccaagaatcaataaaaagaccaagaatcacccctcccctgcccaagaaaaaatagccaaaggatatagatacctcacagaaaggaaataaaattattcttatatgacaagatgccaaaaatcacttgtaatagaagtataacataactatgccaaggtgctatttttcaggtaacatattggccaagaaagtttgatacaccatattgacaagagctggggaaacaagcactcttagacgtggtacaggagtataaatagactcaaatcttagggaagttaatttggtactctttctatataaccaattgatcttttggatgatatccttaacatatgctacatttcaaaaatagctatatatatatatatatatatattttttttttttttttttttttttttttttgagacagggtcttcttccgtcatccaggctggagtgcagtagtgcactcatagctcattacagcttcaacctcctgggctcaagcaatcctcccacgtcagccttcaacataccaggggcagcaggcacccaccaccacacccagctaatttttaaattttttgtagcgataagttttttaattttttaaaaaaatttttttgtagagagaagttttcaccatgttgcaaggttggcctgaaactcctgggctcaggcaatcctcctgctgggattataggcatgagctatcatggctagccaaaaatggtttttaatttataaagaattaaaacttacttatttagcttattttcagagaatacatacaagtaaaatacaccatgttaaaaaaaacccttaaggaagtaagcgtttaatgtatatcctcttaagtttctcacaaatcagtggtattttcataattagcaatcacagcctcagactccaaagtagacttttaaaaattgaatcaaattaggttttaaaaatgtcattctaattcaagtgtccttaattcttgaaaatattagctttagctgaagattttgaaatggtgtatacaacatattaatgtcatcttatcaatgttacagttttattggatatacttaataagttagttttttcaagtactatcatgtaaaaaatttttagtctttaacattttacttactaaaatcatactttatttaaaaatttacaaattcagaccaggtgaggtggctcatgcctgtaatcacagcactttgggaggctctggcaggtagatcacttgagctcaggagttccagaccaacctgggcaacatggcaaaacctcatctctaccaaaaatacaaaaaaattagctgggcgtgttgacatgcacctgtggtcctagctactcgtgaggctgaggtgggagcatcacctgagcccaggaagcagaggttgcagtgagccaagatcgcgccactacactccagcctgggtgacagagtgagaccccatctaaaaaaaaaattacatattcaaaatttaaggcgttattttcttccgcattacaaacatagtagtttccggaatgtctcattgttatggacaatgaaagaattttcttttatttgttctttgtttctaaacaacagtgtggcaagaaattcaccagtttgaaaaaaaaaaatgaagcttataataccatttagtaaaattcagtctcattttttctttcagattggttttcctcccttgcttagtattgttagcagaatgaatcaggtaaaattaataatagagatatatgcattcttttgtttgcattgtgtgtgaaagtatttgaattgttaatacatatactgaattcttacagtatgcaagactttgtcctaagctctttaatggttcttatttaatccttactacaaccctctatggagagttattattgataactactttttatagatgaggaaacagcatttgaggttaagtaacttgcaggtggtttttcagcaagtaaatggcagtactgagattcagtgccaggtagatctaactccagagctcatgctctgtcttaatcatggtgctagagtattcatttctgtagctttcagttataagtcttagattctggggtttgaattaaatacaaggtccctgacttacaatggttcagtttaggattccttttttcccaccatgcctggctaatttttgtattttcagtagagagaggattttgtcatgttggccacgttggtctcgaactcctggcctcaactgatccacccaccttggcctcccaaagtgctggaattacaggcatgagccaccatgcccagccattttaggaattttcaactttacaatgtgtttatcagcacataaccccattgcaagttcaggggcatctgtactaaggttagattgctatttctagttctagatgtcctatacattctattaagattgaaatatgggccgggcgcggtggcttatgcctgtaatcccggcactttgggaggtcaaggcaggtggatcacaaggtcaggagttcgagaccagcctggccaacatggtaaaaccccatctctactaaaaatacaaaaattagctggatgtggaggtgtgcacttgtaatcccagctatttgggaggctgaggcaggagaatcgcttgaacctgggaggcagaggttgcagtgagccgagatcgtgccattgcactccagcctgggcgacagggcgagactctgtctcaaaaaaaaaaaaaagaaagattgaaatatatgatttcttggatcaaaagggaagaattatggagtttggttcttcagttttttaggagtaaggactcttattcatttaaaaagcaaataaaaatttaattttatcttcacatagcattgggtacctttggaagcctttttttttttttttggcagggtctcattctcttgcccatgctggagtacagtgatgtgatcttggctcactgcagtcttgtactttggggctcaggcaatcctcccacctcagcctcctggtagctgggaccacaggcatgtgctaccatgcctggctaattttgtttatttttggtagagacaaggtctcactgtgttgtccaggctggtctggaactcctgagctcaagcgatcctcccacctcagcctcccaaagtgctgggaatacaggtgtgaaccactgggcccagccaacaattttttttgtgggtgatattctcttggaaataatacacaagctgacagtgttacttaatcatttgcattaagatattgtagcagtcatactaaattccatcagtgtcatttttgttgtaaccatcaactgtatttgaataaaccagagattattttcaagagtttgataaatccatctgtatagtttaagaacagatttttctccacctaaatttttattcagatttgtactttgatttaatttgaatttagaaataaactgatggtttttttgttttgttttgttttgttttgttttttgagagggagtctcgctctgtcgccaggctggagtgcagtggcacaatcttggctcactgcaacctccacctcccaggttcaagcaattcccctgcctcagcctccctagtagctaggactacaggcgcacaccatcacacccagctaattttttgtattttagcagggatggggtttaccgtgttggccaggatggtctttgtctcccgaccttgtgatccacccgcctcagcctcccaaagtgctgggattataggcatgagcccaccgcgcctggccaactgatggtatttttacaaatacatctttttttttttttttttttgagacagagtttcgccttttgcccaggctgtactgaagcggcaggatctcagctcactgcaacctctgcctcctgggttcaagcagttctcctgtctcagcctcccgagtagctaggattacagaccccgccaccatgcctggctaatttttgtatttttagtagagacggggttttgccgtgttggccaggctggtctcaaactcctgacctcaggtgtgccattgttttttttttttttttttttttttgagacagagtctcactctgttgcccaggctggagtgcagtggcaaaatcctggctcactgcaacctctgcctcccaggttcaagggattccccggcctcagcctccctagtagctgggactgcattcactcaccaccatgcccggctaatttttgtatttttagtagagatggggtttcaccatgttggcctggctggtctcaaactgacatcaagtgatccacctgcctcggcctcccaaagtgctgagattactggcaagagccactgagcctggccacaaatacattttcttttaaccttgtgaagtctttcaagtagttacaaactaaattattaatagttacaaactaaatcctaggatttaaaccaaggtgttagttgatatttgaaagtgtgaaaatatttgttttaaaagcctcactggggctaggcgcggtgcctcacacctgtgatcgcagcactttgggaggccgaggagggcggatcacctgaggtcgagagttcgaccagcctgaccaacatgcagaaaccctgtctctactaaaaatacaaaaattagccggacgtggtggtgcacgcatgtaatctcagctactcagggggctgaggcaggagaattgcttgaacccgggaggcggaggttgcagtgagccaagatcgcaccagtgcgctccagcctgggcaacagagtgagactctatctcaaaaaaaaaaaaaaaaaaaaaaaaaagcctcattggataagccgcctaatcaaactaattagagtcaaacaaattagctttctttgaaagtttaaagaatgaggccatttttaacatcagagttgctttctaaataaacttaatgaaactcatgttgaattcatgttttattattaatacaactcttctccaccccctctttttttttttaggcaacagtaactagtgtcttggaatatctgagtaattggtttggagaaagagactttactccagaattggtagtattgcatgtttttcttttcataatgtaggcaaaaattagacgttttgggtcaactgtgggccacatatacaatggtgctcctataggattataatactgtatttttactgcacattttctttttttcttttctttttttttttttttttttttttgagacaaggtctcgctctgttacccaggctggggtgcagtattacaatcatagctcactgcaaccttgatctccccagctcaagcaatcctcctgcctcaatctcctgagtagctgggactacaggcgcatgcagccacgcccagttttttttgttttttgttttttgttttttttattagagacaaggtctcactgtgttgtccaggctggtcttgaactgagtccaaatgatcctgcctcctcaccctcccaaaatgctgggaattacaggcatgagccaccatgtgtgcggccttttgtgttttttaaatagagacgaggtctcaccatgttccccaggctgatctcagactcctaggctcaagtgttcttcccaccttggcctcccaaactgtttggattacaagcatgagccactgagcccggctcctttccagtatttaaatatgtttagatctggccaggcacagtggctcatgcctgtaatcccaactactagggagggctgaggcaggaggatcacctaaggccagggaggttgaggctgcagtgagccatgattgtgccactgcactgcactctagcctgagtgacagagtgagaccctatcttaagaaataaatatatggtttttttggatgcacaaatgtttaccattatgttacagttgcctacagtattcagtatagtaatgtgctatataggtttgtagcctaggagcaattggctatgcaatatagtctaggtatagtagactataccatctaggtttgtgtaagtatactctatgatgttcatccagggtcaaaaatcacctaacaatgcatttctcagaatatatctcccttcattaagtgatgcatgactgtacttgatgtgatgctacggtatttatttattttttatttatttgtttgttttgacatggaatctccctctgttgcccaggctggagtgcagtagcgcgatctcggctcactgcagcctccacctcctggtttcaagtgattctcctgcctcagcctcccaagtagctgggattacaggcacctgccaccacacccagctaatttttgtatttttgtagagacaggctttctccatgttggccagactggtcttgaactcatgacctcaggtgatctgcccgcctccacctctcaaagtgttggaattacaggcgtgagccactgcacccagccagtatttatatttatatttatatttgtatatgtgtgtgtgtgtgtatatacatatgtataatctgaactatacttgtttgtagtcaaataagaaacactagaatgtaaatcaacatactacttccttcattgagaaagtcttggagaaaaaaagtcaatgaaagagttgatgtatatcctggtacaaggtacaaactccttatctcattgcagacaagtttgttttttttttttttttttttttttgagatggagtctcactctgtcacccaggctgcagtgcagtggtgccatctcggctcactgcaacctctgcctcccaagttcaagcaatcctcctgcctcagcctcctgagtagctgggacaagtgtagagaatatttaatttaaattaaatatttaatttaaatgctagctttacatagtaaatgtatcccttaaaatttgagtcaagttgaaacatataatttttttttatagaaaaagaattccacaatttgtaaaagaaacctggatttgaatctttttctgtaagaaaaagtcttaactattgatttgagtttgcctgaggaacccatttagtgtgttgtataaattgctatttaaattttgtcctaatattttttaggtttccccgaagtgatatgttgcttagaataaacaaagttgtatatactactggtggaaatacaaatttggtataacctttccaggatacaatctggtgatcatatctgaaaaaccttgatgaatatacataccctttgtcaccattttacttgcaatacttaataaactttccccatgttgttaaatgagattaaacaagggaatgttattaaatactctaaacaagacacttaacattcccttgttaatcccatttaactacaagggatggctgagtggggtggctcactcctgtaatcccagcacttagggaggccgaggtgggcggatcacttgaggtcaggagttcgacaccagcctggccaacatggtgaaacccccatctctactaaaaatacaaaaattagctgagcatggtggcgggcgcctgttgtcccagctactcaggaggctgaggcaggaggattgcttgaacctgggaggcagaggttgcagtgagccgagatggcaccactgcactccagcctggatgacagaacgagactccatctcgaaaaaaaaaagaaaaaggacaaaaacaacatggtaaacattttattatgtattataaataaaaaagatggctacaagatgatattacaactgatgaaattgtattgaaaaaaggttgtacagccgggcatggtggctcacgcctgtaatctcaccactttgggaggctaaggcaggcagatcacttgaggtcaggagttcgagaccagcctgaacaacatggtgaaacccggtctctattaaaaatacaaaattagccgggtgtggtggtacatgcctgtaattccaggtactcaggatgctgagacaggagaattgcttgaacccgggaggcagaggttgcagtgagccgagatcgcgccattgcactccagcctgggcaacaagagtgaaactctgtctcaaaaaaaaagaaagttgtacatacgaataggaaaaacaagaacatttttaaagtgaatcaaagtttgatctggaatgttgggactgcaggttttttcttgtgcttgtggtattcttcacagtttttctgcatcaaatatgtattcattttgtagctgaaaaccccattttaaaagggagtggggatacattgagcctgtcaaagtatttataaaagtgtcaaaagattatttcatctgtagtatagtttctttgtatgtccccagaggacaaaattatacaattataaaatgatttctatatctgtccatacagaacaaagaaaaaaatgtatcttaattttttccagtatttatattcatcttaatgtagtgttctgcttacaaatgagaacttcctatcataagaatatctgaaacaaactctttggagatcagggaatattttgaggtatccaatgtcctgtgtctgtaattataggatacaagagataacacctggctctccaaatgaggctttcttgtctatacccaaacataatatagttaaatgttctatgaatttattcatagcagataatcaggcataacattggacatttaaaaaataaacttctggttcagtatttgtctaaatattaattttttgaatttttttttagggaagatggctttatgctttattggcttgtcttgaaaagcctttgttacctgaggctcattcactgattcggcagcttgcaagaaggtgctctgaagtgaggctcttagtggtaagttgcaacttactgtttaaaattaaaagcacccaccaatttatatggtggtaaagaaggagttcagtgaaataggaaaacacatggaatattttattggtggcaattagatttgtaaagcccaaaataatagtagcttaaataatatggaaatgttttctgagataaagaagtctgagccgggcgtggtggctcacacctataatcccagcactttgggaggctgaggcgggtggctcacctgaggtcaggagtttgagaccaacctggcccacatggtgaaaccccgtctctactaaaaatacaaaatttagctgggtgtggtggtgggtgcttgtcatcccagctactcaggaggctgaggcaggagaatcgttcgaacccaggaggcggaggttgcagtgagctgagattgcaccactgcactcctgcctgggcaacagagcaagactctgtctcaaaaaagaagtaggtaaaaaaattagatttttactaagatggcagtaacccacccacacctttgagttttgtcatatgtggctttcatcctcatgctcatcttatgatccaagatggctgctgtagcttcagccttttttttttttttttttttttcttttattgtgagatggagtctcgctctgtcaccgaggctggagtgcaatggtgcggtctcggctcactgcaacctccgcttcccaggttcaagcaattctcctgccttagcctccagagtagctgagattacaggtgcccgccaccatgcctggctaatttttgtatttttagtagagacagggtttcaccatgttggccagactggtctcaaactgctgacttcaagtgatccacctgcctcagcctcccaaagtgctgggattacaggcatgagctactgcacctggtgtgtgtgtgtgtgtgtgtgtgtgtatatatatgtgtgtgtgtgtgtgtgtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagaggaacaataagaatcctgtgtcttgactacagtgataaatatatttattcatatatgtatattaatatatatttattatatatgaatacatattcactacagttaagacacatatataatatatatgaatatatatatatatattcatcactgtacagttaagacacaggattcttattgttcctttagtaggaaccagggaaaaatttcccccaagttatcccccttagatccctctttatttttttttccctattcagaatctttatttaaaagatagtcttagatgtttctcaaggaatcattaactctacagttctctgctttttctttgagggctcctatttccacatgatgattactgtcatataataaagttttcatgtttcgtgttttacatcttaatagaaaatttatttcaaaagtaataggaacagacaatatttaaatttttctttttttttttttaggatagcaaagatgatgagagggttcctgctttgaatttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactatgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcactacaaccttcacctcctgggttcaagcaattctcccccctcagcctcccaagtagctgggcttacaggcacctgccatcatgcccggctaatttttgtaattttgtggagacggagtttcaccattattggccaggcagtaaaacacacatatttattttaggtctcctcctggacatatttttgttccatagatcagtgtttttatttcattgccagtacctttttaaagctttataatatacttaaatattgggaaggcaagtaatcttgtttccatattttcacatattcaatatctagtttcttgatctacaataattatgctgctgatgataattaacatttactgggcaatttgtgccaagcatttttcttagtgaggaacccatttaatccttctaaggtgggtactgttaacagtttacagatgaggaaaccatggcagagagaggttaaataatattactaccatcacaaagctagtaagtgttagagtaatgatccaaacccaggcaactttgactccggagctaaacttttaactatgctgatcaaaaattaagctaatacctacctcatctgttggtagtagcagttaaatgagatgatatagcattgccctacttactttatgtatagtatctctactctttacaatagatcagagttgtgtttttgtttttgtttttgttttaataaattttttcctttcagctctgttggacttgatttttttccttttacagataatgacacagattcagaaaggttaagtaattggtagctcagcaaaccagtaattaatgaaacctcagacaagtatagtttctgactgcctcagttgagattttacagtattatgcaattatgaaagcaaaaacattcaagtgtattttttgccctcaaaaagttagataaaaatggaaaaagttctagactacaaaaggttctgaagctaacagctttacaatagaagacacaaagatttgaaagtttaggaaaaaaaggaccgggcatggtggctcatacctgtaatcccaccactttgggaggccaaggcgggtggatcaccttaagtcaggagttcaagactagcctggccaacatggtgaaacctcgcctctactaaaaataggaaaattagccgggcacggtggttcacgcctgtaatcccagctactcgggatggtgaggcaggagaatcacttgaacctgggaggtggaggttgcagtgagctgagatcgtgccattgcactccagcctgggcaacaagaacgaaactccatctcaaaaaaaaaagaaaaaagaaaaaaaaaaggaaagctgggcacagtgactcacacctgtaagcccagtgctttgggaggtcaaggtgggaggattgcttgagtccaggggttcaagaatgcagtgagccatgacaaaatctgattagtgattttcctttttatttaatcttataattacataaaatagttaccttgccaaagttaaaattataattcaaggtacatttggagtattttagcatccatctttatcctcattatcctcttttttcctttctcctctagttaaccattgtattactaatttttgtttcatcttttcattcattgtttctttttaaaagtataagtaggccgcatgtggtggctcaagcctgtaattccagcacttcgagagactgaggctggagaattgtttgagcccaggagttcaagaccagtctgggaaatgagccatgatcatgccactgcactccagcctgggtgacagagtgagaccttgtctcaaaaaggaaaagaaaaatataaacaaacacgtatattggcagtcctacacatactcacataaggtagcatacagaacaatctgttctgtacttcgttttttttcacttaataaatcctggaaatcatactttagcagtataaatacgttcctcatactttagcagtataaatatttccctcatttctctttttatggcttcataattttccactatgtagacatactatagcttatttaaccagtttcttattgatggacgtttgggttgcttatggtctttggctattaaaaatagtgctacagttaatatctttatacataaattttttgttttttttttactaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcactttttttttttttttttttttttctttgagatggagtctcgctctgtcatccaggctggagtgcagtggcaggatctcagctcactgcaacctctgcctcccaggttcaagtgattctcct

SEQ ID NO: 9028 - DNA, 502 bp, Homo sapiens
gtcacttataacttacctatttctgtatcaggtaggaatgttttctgctttaagtaacacaaaagatccaagtggcaatggttcttcaaataggggtttttctcagataacaagaagtctaaaggagctggccactggcattggtttagtgactcagtgatatcaggggctcagattcctttagcctttctgtcatggaaacaagatggccattgcagttcaagccaatgtgtctgtattcaagacaaaaagaaggggaagcagggccttccacatctgatccttttctcataaatgtaaaatcttttctagaaatttagatcagacttgtgttcatctgctagccataaatgtacaacatgatcaccccttgttcccaggaaagtgggaaaatgaagctgtacgcctttccagtctcactaatggaaggtgggaaaggaaaatggggattgggaattaccatggatcagacaaccaacagttttgccaccagttataatta

SEQ ID NO: 9029 - DNA, 309 bp, Homo sapiens
gccgggcgcggtggctcatgcctgtaatcccagcactttgggaggccgaggcgggtggatcacgaggtcaggagatcgacatcatcctggctaacaaggtgaaaccccgtctctactaaaaatacaataaattagccgggcgtggtggcgagtgcctgtagtcccggcggctactcgggagcctgaggcaggagaatggcgtgaacccgggaggcggagcttgcagtgagccgagattgcgccactgcactccagactgggcgacagagcgagactccgtctcaaaaaaaaaaaaaaaaaaattcagtt

SEQ ID NO: 9030 - DNA, 16982 bp, Homo sapiens
ggggcagctgggctccagagtccctcgggtctcaggtcatggcggtcgcggggcccgcgcccggagctggcgccaggtaagcagggcggtcggggaggaggtttgggagcaggagttccgggctgtagggaatgggctttcctgccctccgtgcctcgtccgccgccctggcgcccccgtctcgcccccgtgacttctgagagaaagaggagctctcgaaggggcgtccgccctcccgccgctctaggccgctccgcaccggccgcggccccctccgttcttggccggacttgtgccatctcctgcggtgtgggaccctcaccctcgcaactggcattctttttttgaaaagaagaacctcaggtgcacaaaattgagttgatccttctcagttcttgacaccctgtgggccaatgcaaggctccttgtttattttatcacttcctctcttcgttcctattcccagacccctttcactccccttttcagacagccactctggtgtgttatataagtggctttacggtccaccttgggtaaatttgtgcaagtgttactttgaaatctatatagcggtttcgaattcttcaatataatatgctgtgatttttctttaaacctttttcctcaacattgtgtttttgagtccatccatgctagtcatcttgttttcacttctgagtgcttgcatgaggggtgctgtgtgcatagacttattcccctagtggtggatagatttttttctagtattaacacccccacaagccacactgtaacgaatattctggcagttgtctccttgtgcatattgttgcatttctctgggtatccaccccagagttgggtcctggtcatatctaattttgctggattgttctttggaatggtcacactagtttatacttcccgacgggcagtgcataaagcttcctgtttcccggtatccctccatcgttcagtggcggctggttttgtaatgtttatcagtctggggggtgtaaggtggtatcccatcgtgtacattttctttctttctttctttctttcttttgagacggagttttgctcttgttgctcgggcaggaatgcagtggcatgatctcggctcactgcaacctccgcctcgggttcaagcgattcttctgcctcagcctcctgagtagctgggattacagacgcgcgccaccacacccagctaattttttgtatttttagcaaagatgggggggttggccagtctggtcttgaactcctgacctcaggtgatccacccgcctcggcctcccgaagtgcagggattacacttcccgacgggcagtgcataaaggaattacagacgtgagccactgctcccggcctacattttcatgtgtttattaaacgtgggttttcccttttttgaattgcctgtttatatcccttcccacttctctgtggatttcctatgttcctggcttgcaggaattcttgtaggctctagatttagatcctggccatgcccggtggctcacacctgtcatcctatcactttgggaggctgaggtaggtggaccactggagtccaggagttcaagatcagcctgggcaacatggtgaaaccccatctctaccaaaaatacaaaaattagctgagcgtgttgacgcacgcccgtactcccagccactaaaaaggctgaggtgggacagtcgcttgaacccgggaggcagaggttgccctgagctgagatcgcaccactgcattccagcctgggcaacagagcaagaccttgtctcaaaaaaaaaaaaaaaaagattttaggccaggcgcggtggctcacgcctgtaatcccagcactttgggaggccgaggcaggtggatcaccggaggtcaggagttcgagaccagcctgaccaatatgatgaaaccccgtctcctactaaaaatacaaaaattagccgggcgtggtggcatgcacctgtaattgcagcttgtcaggaggctgacacaggagaatcacttgaaccagggaggcggaggttgcagtgatccgagattgcgccgttgcattccagcctgggcaacgagcaaaactccgtctcaaaaaaataaagatttcaagtccttgttggttttgcactctgcagataccacctccaagtcttctaacttaatctatggcactgtgttgaataaaaacatttaactctaatgaagttaaattcatcagttttcccctgtataggtttttaaggtatcttcattaagacatttttctacatttccttctattaacatgatagtgttacttttcacgtttagatttttaatccatttgtaattttttaagttttttgtttttggttttttttttttttttgagacggagttttgctcttgttgcccaggctcttgttgcaatggcgcaatctcagctcactgcaacctctgcctcccaggtccaagcaattctcctgactcagcctcccgagtagctgggattacaggcatgagccaccacgcttggccaaagaatttcctttgtatccgtggtctgttcccagcctaccatcttcagcatttgaaaaccattctttctgcatggcctggaccctctacagaacaatgtggatgagcttaataactactccctaaggcttaattattgtcttgggcttttctctgcctccccaccttctcttcaggcccaggttagatctgcaatttctccagcggttcctgcagatactgaaggttttgtttccttcttggtcatcacaaaatgccttgatgttcctgacccttttgtgcctgaccctactgggtgagtgagtgagcccagactagaggagggaggggagctctggtttggggtccctttccatcttttttttttttttttttttttttgagacagagtttctctcttgttgcccaggctggagtgcagtgacataatctcagctcactgcaacctctgcctccctggttcaagtgattctcctgccttcgcctcctgagtagctgggattacaagcacccaccaccacgcccgactaaactttgtatttttcagtaaagacagggtttcaccatcttggccaggctgatctcgaactcatgacctcaggtgatacacccgcctcagcctcccaaagtgctgggattacaggcgtgagccaccgcgcccggccccttttcatctctttggggtgctgatgaggcagggactcaggaagaagcctcccttctttttaacccctcatcactgatttcttactcctctccctcctttcagagcaatttgtgatctaccaggttggcttgatccccagtcagtactatggggtcctgggaaacaaagacttggaagggtttaagactctgacattcctggctgtcatgctcattgttctgaactccacggtaagatctttccctctctctgtgtctctcgtcctctccagtccagtgtgaccgtaatgcctagtggaacttagcctccaggaagcaggaagcaagctgtgggggtgtgtttcctcccttttctgggaactaaagggatagttgcctttattaagcacgttgatcttgctattggcccacgtgggactgattcctcagatgtttccactcctgggcccaggccacaggttctggtttaattcagcatttagcagaactgatcattgcccctttccttcctagaactcttatttccggcagctcattaaaacggctcagcagccagagctgctgctcctcctctgcgggaccgaggctgtgactcaccctggcaccatgtcacacctcccagcctttgaacagtgctttcttgcagaatggcctcctcccctacccctcattcagtaggggggctaccacctgctcactcttcgtcatccctccgttgtcacctctttcaagtctttctcagctttctcctttgtgtctcctccaccaaactctgccctttttctgtacttaacgaattccttgagtttacctcgctgtaacactcctcacacgcttgtaattgttttctggctaaactgtgagctcataatgtccctagtgcttagcacataggtgccctggaaatggtaaatgatgagactcagggctgtaccagaactcaagcctaatgctgtctgccaggctgtgccacctgttttcttggggaagccactgctcatcgtaccatggccacttttgttgggtcttcggtcagtaagcacctatgcatacaaatctctgtcccaagcttgggggacaaaggagtaagaacataaatggaatcgacaatatggtctccaatcttcagaagctcatctactctcaaaataagacagtgtagaaagagggtcttgcctctggtaagccctttaatatttggtgaaggaggctgggtacagtggctcacgcctgtaatcccagcactttgagaggccgaggcgggcggatcacctgaggtcgggagttccagaccagcctgaccaagatggagaaaccccgtctctactaaaaatacaaaattagctgggcgtggtggtgcatgcctgtaatcccagctactcgggaggctgaggcaggagaatcgcttgaaactgggaggcggaggttgtggtgagccaagatcgcgccattgcactccagcctgggcaacaagagtaaaactccatctcagagaaaaaaaatttggtgaaggaatgaacacgtgagtgagtgaggaagggaaagtcccatgactcgatgatttaaaaaagaaaagtgctgagtggacggagtaatcagagtcagagtgggctgggatgggtcagcggaggctcttgcgagccttgagctttgagctgagattttcaggaagccatctctcccttccccttgcttcccccactgcacagctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccgtaggcgccccaactcagtcctttctacactctgtgtggtcctttccttctggcctagccctggagactgctggtggcagacaccaaggagatcatctgcagtcgttttcaaatgctgctgcccagagtcatgggggagggtgccctgcagaggactcctggagaagctgcagggctgtgaataggcagctaaaaagaagaagcctgccaggtgcagtggcatgcacctgtagtcccaacaactcaggaggctgaggcaggaggatcacttgagcccaggagtagtgcaccgtgagcacacttgggaatagccactgtactctagcctgggcaacatagcagaaacccccatctcttaaaaaaaagaaaaatgttaggagcagctttcttttgtccttttcatactttatatcttagtcttccagtaagaagactaaggggtttctttagagggttctaaagaaaatgtccttgctagaaaaaccagctcttagattttcatcagtaaaaaaaattaccactatccaggactcagtctaggattcacatctccattctatcaccactcaggttataactcttaaagtcaccaagccccaggttccccttctgtaaaatgaggacaataatagttcctatctcaaagggtgtagtgaggatgaaatatcattcatgtaatgcacatgtacagtgcttgacacatagcaagtgtttcagtgtaagttagctattgttattttacagatgaggaagctgaagcccagagattgcaagtgacttgcccaaggtcacgtcactcattgggaataggaatcagtatggccctagtggtgagatgagacatagggggtctccttcacacccatcccctcactcaccaccttcctagcaagcactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactaaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaaggtgaagcctccctcctccccagcctggtgtttccccagagggccctcagtcagctctcccaggtcaaggtccaagagaagcttatttcccctctctcccaccgtaccttaccacgtgctcacccatcccacgtgctcaggcccctgcccttcctttggccctgtgttgcagtgtcacagatatcctggctctgagagctcataccagatgcccccacataggagcagagggcccattgggccactcagattggacaggggctacctgagagggaacaggagtcagggctgaggcatgtggggataggtggcaccccacaccctctcccttctctccctctctctctatttcagcacaggctggctcgggcctgtgagcatcttcgggtatttcatcctggggaccgtggtgaacaaaactttgatgggccccattgtgatgaagctggtgcatcaggagaagctggagggagattttaggtgtgtctccctcacttgaggtttctgggctggggcataatagttaaggaaggggatctggagtaaaactgcctaagttcaaatcctagctgtgccagttactagctgtgtgatcttggagaggtctttaacctctccaagcttcaatgttcttgtctctaaagtggaaatggtaccgttgcctactgagaggattaggaggattaatgaaatcatacctgagaaggtctgagaaccgtgtctgcctggccatcaccatcgtcattgtcatctcttggccttctcactgccctggcataaccgccctgtcttggatcagttgggtgtggcagccaatggatccagtgcctgccctgtgcttcttgtccccctcctttgggccaggccctgggaggaggagatgctgtgagcaggaatacccctgtcctctctgcagaaagctgaggggcagccctgtctctgcagagctcctgccacaccacctagccctggggttttctaccccataacagtccaggaaagggtcagactgaggcagccacggttttgaggcagagccgggctccgcttgggcggtctttgtgatccaggactccaacaagagtgaggccagtactccctgttgtcagcacacatttccctttggtccgcccaggttcaagcacatgcagattcgggtgaatgcggagcctgctgctttctacaggtgagtctggagagatggttccccttctgccttgccagagctgagagtggagaaggaaagatgaatcctcaaccctcccaccaccaccgagctcaggggctgagtgttgtcacacttggctgtgaccctctccctctacctccccctgcccttgcctgcctcatccttaggtccaggggtttgcttctgaagctggtggttccttactgtggccagctttagtcttagtggcctagcgtggggcctgaaattgtcaaatgaatgaatgcctcatcctcttgctggtgactgtaagacatccgtctgcctctgctcttctgtctgttaagaagctttcttgccagtgcctgaggttcaagcctgatcctttgtctccgtagcgtgggatggaatgggagcttctcagaaaaccaggagacctgctccccacaatgctgtctaatggagccaagcgtctggtctcctgacggcagcagcaggagcagcagcagcggcatgaaatcccatcccttccctccagggccagaaccggtccctgtgctctgccttatgtgaggcctctgaaatcagcgttaggattgatagtgcaggcagaggtttgcgtttaagaagtggaagctactccttggctctgtacttggggtggatgtgatagccctgggacctttgctcctcagtctctgctgcagtttgcaacctccaccacttgagggcaccaagaatactgggaatctgcgctggggtggggttgtgaggtgggcagggctgggtgtgtaaaaaagttgcttttggaggccgggcatggtggctcatgcctgtaatcccagcactttgggaggccgaggcgggtggattgcctgaggtcaagagttcgagaccagccatggccaacatggtgaaaccctgtctctactaaaaatacaaaaaattagctgagcatggtggcgggcacctgtaatcccagctactggggaggctgaggcaggagaatcacttgaatccgggaggcagaggttgcagtaaggcaagatcctgccattgcactccagcctgggtgacagagcaagactccgtctcaaaaaaaaaaaaagaaaaaagttgcttttggattctgcagcctctgctcatgaagctctggggaaggcaggttagtttgtagagtttcagatgagttcttctgtggcctctgtgcaaaatctgaaatctccctccaccttttctgcctagcgaatttcttcccatccttgaaaccccagatcacctcctctggagagccttcccagactcccttaatggctaagcctatctgctgccatggccctgagggcacacttagtactcctgattccaagtgaagaatgcagtgtgcctgcctgccctctggactgagagctcctcaaagacagagataattttctcatttctttattgcactagctaactagtgcaatgcctggtacacctagtgaccgctctgtgtatgtttatttaacaatagtttttatttattgagggctccttatgtgcttggcactttatatttagaaacttttaattctaactctaacctattacataggtattattggctccattttatagattaaaaaaactgaggcttggaggcttaagtagcctgcctgtgtcacgcagctagtaactggccagagccaggatttgaactaggtctgcccaactctagagtttatgttcttcacacagacaataccattaaggcatgactgaagccgtgaatgggcgctaccagtagacagatcctgagaccaagatcatttgaatggccttggtttctaaaggagggtgtgatatgggacaggcggccccccaacctggctgaacctctccagccctgtggacatcccagcctttccttgtcagagctgggcatgtggagcacatgaggacagaccgcaggctgcagagactccttcagacccagagggagctgatgtccaaggagctctggctgtacagtaggcgagggggcccagggaagtgggaaccatggggttggactggtctgcttcccttcccacacctctctacctcctgtctgcaaggataaatgtgccatgatgaaggaattaaccggggatgaggagggggggctgttgcctttctgtgagtatcctcaggagaatgaggatccagagagtccacgtggccctacttggcgtcctgctccctgtcttagggttgtgtccgctgtagggcatgtggatggttcctgggtgtctcacagatgtgttttctacagtcggcatcaacacctttgactatctgggcagcatcctgagttacgttgtcatcgcaatccccattttcagcggggtctatggagacctgagtcccgcagagcttagcaccctggtcagcaaggtgagactccctcttggtcaccccacatgctgtccctctctgtccttggcccagtgtctgtgggctcgagtcgagacctgcttgacctcttcccatcctgtccagaatgcctttgtgtgcatctacctcatcagctgcttcacccagctcatcgacctgtccacgacgctctcagatgtggctggctacacgcacaggtgaggccgtgtcccacccctctggctcctgagcaaagtgtgtgctgctggcagaagtggctgagtgaaaaaaggaacagagacataccatgtactcgtgggtgtgagataggaaaaggagttcaccttcacctggctcccagaccctgcctcagattttcttttcttgttcagaattgggcagcttcgggagacgcttctggacatgtccctgaagtcacaggactgcgagatcctgggcgagagcgagtggggcttggacacgtgagtagcgggctggcagagcagtagttgaggctgcaggctgtggcatcacctggcttgggttaccctggagtcctgccctttcccagctgggcagcagagttgtaaggagtaaatggaaatggaatgccaggcacatgtaagttcacagtcgatgttgctgttccggcatctgttgtgttaatttacaccattccccggccagtggaagcaaagtacacacaccttctgcctgagataacaggaatctgcagtgtcctccccttcctgtgcttcctcctcccgctgattcctctccctgcccctttccttggggcatgtctgtctttgttcccccacctcactcagccccagagatgtctgtatccgtgtgtctgcgtggatctgtaatatttctgtgcattcaggatttgcttgatctccacactttccttgggcagattacctaactgttctgtttcttcatgtctgaaaaggaggtcataatgaacttccttcacttgttgtagggattagatatcatcatccatggaaagtgcttggacagtggccacatcataagctttcaaaaatcagtctgaattccagggcctacactcaacttgcttttcttaggagctaataccttaactgttgcttctgttccaaatgaaagcttcatgcaaccatgagtgcagaggctgggcatgaaggagggtctgtaggaaactggaattgctgttctgtggggagccaggcatccatgcagaggcagaaactccagaaccatttagctttaaccactcccattcttgttattagtactctggtcacactgtgatgccatgaagacccaccagcattagaatttgttgaataccgctctgcaacctgggcagttacttagccacctgattcttagtgtcctcatctgtgatgatatttgagactcatgggcattagactgagtaagatcagtcccataaggggctttgtccagccaggcagagagtagaagttccacccctacccctgtattaatgtgctcaggctgccatgacagaaaaccacaaaccggctggcttaaacaatagaaattaatttcctcacaattctggatgcttatggtccacgatcaagttgtcagcagggttggtttcttaggccactccttggcttgtagatggccaccttgttgctgtgtcctcacgtggcctttcctttatatgtgcgtgcccctgccacctctatcttaagaggacaccagtcatattggattagggtcccaccccaacaacttcatgttaacatcatctctttaaagaccctgcctccagctgggcacggaagctcacgtctataatcccaccactttgggaggctgaggtgggcagatcacctgaggtcacaagttcgagaccagactggccaacatagtgaaaccctgtctctactaaaaatatgggcacggtggtgggcacctgtaatccagctactcaggaggctgggacaggaaaatcgcttgaacccaggaggcggaggttgcagtgagctgagatagctccactgcactcaagcctgggtgacagcaagactttctctcaaaaaaaaaaaaaaaaaaaaagaccctgcctccgaatgcagttacattctgagtcactagggggctggacttcagcatgtgattttgggaggatgcaagtcagcccataataatccacaggtggtggctcccgggagcagtgcctcccccacagcaatactgaccctgcccatcttcctcacgccccctctcttctctgacacagacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgagagccaggccctccctgcctctgacccagcctgggccctaggggtggggtgaaggcggggacggtgtggtagaatccattcttttctgttggggaacaaggaagagaggagacaggcagttgcctcttctgggagatctcacaatggaggtttctgtgggctctgcaggctcagtgcagatgctgacggactttgggccccatggggtgctattcctgccacaaaagccattcttcactgacgggacccttcgggagcaggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggaggttccagtgggttctggagggagggtgggctgtgtgcagctccgtcttttgctcgccctcctaggttggtgtggtttttttcttttctcaggtgatatatcccctgaaggaggtctaccccgactcaggtgagctggtcctccttaggtcatgtcctctccttctgtcatggttgtccctgctctacctgactgtggcctcatctgtgcccttggggagaggctccagccaggccgctgattcaaggaagaggggctcctctcctcttcctttgactgttttggggtctgtacccagatctcacctcattctttctgtccttaaggagagatgcccactgggacaaggaaagtgatgccttccttcacccaccccttcccttatgaagatctgcaacctgtggtttcaaagccttcgcccagcattctgaggcccccacccctgcatcatccatgatgtgccctgtctattctttttttttttttttttttttttttttgagatggagtttcactctgtcacccagactggagtgcagtggtgtgatctcggctcactgcaacctccacctcccgggttcaagcaattcccctgcctcagcctcttccgtagctggggctacaggtgcacgccaccttgcctgcctaatttttgtatatttagtagagacagcgtttcaccatgttggccagggtggtctccatctcctgaccttgtgatccacctgcctcggcctcccaaagtgttgggattacaggcgtgagccactgtgcacagccttgccctgtctattttgaccagccaggaggctctggctttttgcagaaggcttctttgttgtgcaggttctgccgatgatgagaggatcttgaggttcttggaattggcaggcctggtaagtggggagagggaccctcaggacccgagcccacctgggagcaccagctacaggtaggcaggtgctggccctgctatgcttgggcccaggactggaagtctgaacctggggtggagaatgggagtatcagttgacagtgtgtgctgttggccaggtttaggcacgaagggggtagtgctctcattggagaattttaaaacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaaagccaagctatattcttcctcctctagcagtcctctctcctacctttcctcaggtatgatgttctgtccccgggggagatgcaacggctctcctttgcccgactcttctacctgcagccgaagtacgcaggtgaggtctcgccttgtggctgcacatgccatgcgctgtctgcactcacgggtgtagcagcatgtgttcacaggcacccaggcacacctgtgaatggctgggcttctccgcattccctgctggagaggacagcaggccctgcccgtgtaaacagtgcctggcatcgtcagagttaacactgaatatgcggtactgccagctcataagcttgcttttcttctgttttcttttttcttttctttttttttttttttttttgagacagtctcactctgtcacccaggctggggtacaggggcacagtcatggctcagtgcagcctggaactcccaggcttaagtgatcctcccacctcagcctcctgagtagctgggactacaagcatgtgccaccacaccctgctaatttttttatttttatttttgtagagacagggtcatgctatgttgcccaggctggtctggagttcctggactcaggccatcctcccacgttggcctcccaaagtgctgggattacaggcatgaaccactatgcctagctcataagctttttgcctggcagcagctggagccaggagccaacattgaagggttataattttatgctcctctggctccaccatcaaatgaatgggcacccatcctcctctcccaccaagctgtgcctggcaggtggatgggtgtggacttttccaaagactgacattcttgcgggggactgggattccctggattgagtggtcccagggagtggctggtgcttatctatagaagctgagagatttcatgcagctgctcacaggctattcccttggagagtctggccctctgctcctctggcccatccttctccctgaggcagggcttctggaagccagagcagctttcagcctcccctgggtcccagctggggttgagtatgggtgggaggagaagcagcggcggcagagggcagggctttgatctcttcctctgtgctctgccccctcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatc

SEQ ID NO: 9031 - DNA, 534 bp, Homo sapiens
cactaacttccaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatttttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatgg

SEQ ID NO: 9032 - DNA, 5877 bp, Homo sapiens
ggaatttgggatttctattaatttgaaacaattagtgtcttaaaatattggagaatatggtatgtctctccatttatccacagatgtttaaattttcttagttttttcatataggatataatgtttgatttgttgtttatttccacttttatattaatctttttagctagcttggatttggaagtgaactactgaatctttttttctttttttataagcttttgttaggagtgataaacccaaactgttcagaggactgcaaatcaaggtaaggtgattgtagtggagatctcttttttccagccttaatttctttattttataattaaagtaaatatttgaataaatggtttcccccataaacatgtgcaaatattatgtatcaatttaaatttttaatttcactgaaaaataatttttttaaattaatagactttatttttttagagcacttttaggtttatgaaaatttgaatgcaaaggaaagagtattcccatatactccctggcccccacccccaccctcagttttcctgttgtaacatcttgcattggtgtggtacatttgttacaattgatgaatcaatattgatatattaattaaatttaatagttcgcattagcattcattctttgtgttgtataattataggagttttgccaaatgcataatattacatatctaccattacagtatcatacagaatagtttcactgccctaagaaatctccaatcctcacacgttcaggtcatttctctccctcttccccaccccctggcaaccactgatttgttgttgttgttgttgttgttgttgttgttgttgttgagacggagtcttgctctgttgcccaggctggagtgcagtggcaccatcttggttcactgcaacctctgcctcctgggttcaagcaattctcatgtctcagcttcctgagcagctttattacaggagcacgccaccatgcccagctagtttttttgtatttttagtagagatggggtttcgccacattggtcaggctggtctcaaactcctgacctcaagtgatccacctgccccagcctcccaaagtgctgggtaatattacaggtgtgagccactgcgcctggccaccactgatttttttattatctctataattttgccttttccagaatgttatatatttggaaccatacaatatgtagccttttcagattggcttcttattactgaatattactcgttattaccagttttgtcattcacctgtggaaggacatcttgattgcttccaatttggggcaattttgagtaaagctaatataaatatttttgtgtaatttctgtgtacacataagttttcaactcattgaggtaaataactgagtgcaattgctgggtcatacagttaagattgtttaactttgtaagaaactgcaaaactgtcttccaaagtgatgacatcatgttgcatttgccctagcagtgattaagaggtcctattgctccacatcctcaccagctttaggtattgttactgttttggattttagttgttctaataagtatgtgatgatatttcattgttattttaatttgcaattccctaatgatacatgatttgaatatcttttcatttgtttatttgccatctgtgtgtctttggtgagatgtctgttcagatcttttgccctctttttttaaattgtggtaaaaaatattaaatgtacaatcttaaccaattttaagtgtactacagtccagtattaagtattttcacattgttctgtaacagttctctataactttttcatcttgtgaaactgaaactctacgcccattaaacacttaattttatctttctgtgcccaccaccacccccgccctcctgccagcccgtgacaactacctgttttctgtttctatagttttgactacttcagatacttactatgagtggaatcatatagtatttgtccttgtgactgatttacttggatcagggttcatccatgttgtattgtgtgacaggatttccttcctttttaagaatgcatagtattccactacacacacacacacacacacacacacacacacacagagacacacacttttttttttttttttttttttttggacatggtcttactctgtcacccaggctggaaggcagtgatgtgatcacagctcactgcatcctcaccctctaaggctcaagcaatcccgccacctcagcctcccaagattctgagaccacaggtacacaccaacatgaccagctaattttttttatttttttatagagatagggtcttgctatgttgcctaagctggtcttgtattcctgggctcgggcgatcctcctgcctcagccttccaaagaacggggatttacaggcatgagccactgtgcccagctcccattttctttacccatgcatccatcagtggacatttgagttgcttccatcccttggctattgtaaataatgcttttatgacatttgggtgtgcaaatacctcttcaaggcccttttcttagttcttttgagtctatattccaagaagtggaattgctggatcatatggtaattctatttttaattttttgaggaacctctatactgttttccgtaatgacttcaccattttacagtcccaccaacagggcacaagtgttccaatatctctatatccttgtcaacacttgttattttctgttttttggtagtagccatcctaataggtatgaggtactgtctcactgtggctttgatttgcatttctcttaaaataaatggtgttgaacattttgttgaccatttgtttatcttctttagaacattgtttattcaagtcctttgcccattttataattgggatttttggttgttgttgttaagttgtggaggttccatctattctggatattaaacctttatcagatatatatgatttgcaaatattttctccccttctctgggttgtcttttcattctgttcattgtttcatttgatgcactgaagtttataagtttgagtggtcctgttactgtttttgtttttttgcctacttttaaattgaggttttttgtttgtttgtttgtttgtttgtttggtaagctgagctttaagagttctttgtatattttgaatacaagttctttatcagataggtgttttgcaactgattgtggcatataattccttatacacattgctggatttgactgctaatattttgttgaggatttttacaactatattatatctaatttcttatttccttttgggattataataagttttttaataaataaacatttttaaatattgggatctcaaatccaagcaaaaaagaaaaaaaaatccttaacttaagaagtaacctgaccggctgggtgcggtggctcccacctatgtaatcccagcactttgggaggcggaggtgggcagataacctgaggtcaggagttcgagaccaacctggccaacatggtgaaaccccatctctactaaaaatacaaaatgccgggtgtggtagcaggggcctgtaatcccagctactcgggaggctgaggcaggagaattgcttgaacccaggaggcagaggtggcagtgaaccgagatcacgccattgcactctagcctggacaacaagcgaaactccatcccaaaaaaaaaaaaaaagtaacctgaccaaaaatggttaagtagtaatgttattattgattcattagcctggatggcctattttctaaactccacaaatgggttgggaatataccaagtgttaataatcacatctgagctagtctccatctttggagttcacaaccccagaataccctagataaactgaagcataattctggaagaagttctaagaactctgtcatcactgccgaactacataactacattgttagttatccaatgctacttaatttaaaattggatatttgatctcttaatgaatggctgttgtcacatttacccagaattagaatttctcagagctctctggagaaatattggacccaactaatggatttgaagtttcaggaacccagcctaattctaaactgattacaaataaaatcattagatttgttaagccaagaaaaatgtatgatccagtatgtgattgattctgtgtctgcaaatttatatgcacagcgtattttaaaacattgctcttataccatcattttctcaactattttgaacttgtctgcctccattcaattttaagttcatttgagagtatcatgtgggcattacatacttgttaatttcaataataagctcaaatccccaataaactgtcttgctactaatagatatttttctctttaaaagtaaagtaatttcacttgcttctagtcccagggaggctgaggtgggaggatcacttgaaatcgggaggtggaggttgcagtgagctgagattgtgccactacactgcagcctgggtgacagagcaagaccctttctcatgaatgaatgaatgaatgaatgagtgatttttttaattctcctttttttccgaaatcctgtaaaactcttctccttaaagatttcctttaagacttgtttattgtcatgtctaaaagcctttttttaattactaaatttaaactggattgaattgctttgtcttagatgaggctgagaaggttgtttctgaacagaaagtaatgatgacgtccctcttttttgtagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaac

SEQ ID NO: 9033 - DNA, 340 bp, Homo sapiens
atttatttcaaatgtttattgaccatttgtatatttgtacatattgctatacatagtgttttttcttaattatttgtaagagcccttttatatattagatgttagagataattttcttcagtttatcatttttatttttaatttgcttatggtggtgttttgctgtcctgatgtttccatttttacataggcgtatctataaaacatttccttttgggtcatgcttaggagtagatttttgtgttccatatttatgtaagttctctgtgctgtaggctttggtagtatttttaacctctcctttttagcagttatcatgactcattagttctgtgatttt

SEQ ID NO: 9034 - DNA, 16285 bp, Homo sapiens
gtcaatatttagggaagctttgtcatatttactaaatttcataatttcagaaaactgtttaaaacaaagagcaattgatggataaatcaggaatagattctcttgaccatgtgacatctgatgctgtggaacttgcaaatcgaaggtgagtggattcaatcatgtttattgtatctgaattatgagaaactattgtatataatgagtgacagtaaagataattttcaggaattgggaaagaaggaaaactagatttcactgaccttccaagtttatctagttacatagattgatataatagcattgcaaatactttaaattcaaaatgtgaatatattatgggacacattcgtcgagaaaaaatgtattctttgggtcatattagcatctcttccagactacatcctccggttcggtaggctgtgtttgttttactcagacactcttagcagtgaaccgaaccatacagccttttggagctcatacattgtcttgaaagatacagtttttttgtaagctgagcatagtggtgcatgccattagtcctagctagctacttgggaggctgaggcaggagcatccctggagtttccaggagtttgaggttgcagtgagctgtgattgcaccactgcactccagtctgggtgacagcaagacgatgtctacaaaactctttaataagagctgtagcattatgggctatttaaataggatgatcagtagaaaggctagctggttctgagcccatcctttaaaaaatttttaattctgggcatgttttctgagttggtcttggaagaaatgtacatttaggactgggtattaatggtaataagcagtaagaaaagaagatgaaattaatttttttcccatttttctagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgaggtgagtcagcattttacatacatggctacacataactcaagatgcccaaaatgatttgttggccaatttagaattgtctcagatatactgggaacagactgtctgcaattttgatactcttctatactgacttacccctaaagtccaccctatccttcaactgaatcttgacttgtatctcttaatataactacactttgccatatttaaaagatagtgctccaaggctctttgtataaaatcctttgatcttatcccatctcaggtctttaaacacaaccctaaaactcagtggggataataaaagctcacataacttgaaattacttttgcagtaacctaaactaaaaccacacatgccttatgttcagtggatatattcttaaggcctagatgtttctaagccaattatctgaaaaatacgctaatacttaggagtagacttttttaaatatttgagagttgtatgttgaatgaattcagaattaatttatgatcccttgccagaacctgaaattttatttgggaggattaatacatgttaatctcttcagttaatctcttaagtttaaggtgattatagtaaacattagaaatcttattcctgtttttacattttaaaatgcctttagtaagtcccagacatgacaagatatgtacttcacttttccatgttaccagcttaggtaaattcataattgtaatgtgaattttaataatcagcatttgataagtccacaagtggggagtagttaagatagcaaattcagagtctttgctaagggggggcattgccctttttgaacataggcacctgctgggtcttaaaaataaaatctcgacatacttatggtgtttttaatatatagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgtaagtggaatcatatgaaatactttggtaataggttataaattaaatttctatgttaattgcttcatattttgcctttaatatagttatacttaaataatgaacaaagatacagagtatgacaattgggattattacagttgagccaagcttggcacaccgttcatctagaattctccagaacacaaaattctcaaattttgtgtttcctttgactagtattgcagtttcagttatatttcagagtggaatatacaactaattaggtcatcgaagattctgtcatctcgatgataaattttaatattacagagcagaggatgaggatgcaacacatcttgaagataacgaatgtgatatcaaattggcagtaagtgacttatttttttcctattccattttgggaaggcaggagttggttgatacagaaggaattatatttagtttttctcttacacttcatttaacttttgaaaagctctataagtttactgcaggaaatgcaagaaggaaaataattttttagagacttgataaagaacatggggttttcagtactatttttaataagtagcattctgatacatattattgctagttaggatgtcaaatgaaaaaataagcaatgttaatttggatttttaacatctacatgtagtctctaggttatctgaagtaatccagggcattcagctatatgtaattactaaactatttgagttattgcttaatccatgattttttgtttgttttatgcagggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaatttcatgttgatgatatacacaatggctttttgttttaaaggcttttatcttgagaacatggtgtctggagttaaaggtatgtctcaatttgagttttcacatcatatttgtttatgtgtaggaaacagtatgttgtcagagcaagtttcattttattcagggacatttctaccatgcttttaattcccatttatactgatttctgaaaagaagaatcctagattcacacattttatagtgatgtgtcagattcattttagttgcaagcattagagggtcctgaatttgttagtttgtagcaataatcagaactttggatttcctacttgaagcctacagcattattttgaattaatgcacaatctaaaatgaggcagaggattttatggtttaatgcaaaatatagtataataaaagatgattacacaggtcataagaattcataaatttgaatgatgtagagtttgattaaaagttatataatgccaaagtcgtaacttacaggcacattatattcctgtattttataatggatgacaattaattttgagccaagaattaaaatttgctgaaatcttcgaattgggaaaacaacatcctctgttgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggtaagattctctgtttctattgattctgcttgtttccctctatcagtagcactgccagcataacaagaacttcgtacaaatacactactaagctttaaagacttttacaatgcctcattctagagaatgggcactgttgatcatggtgtccaaaaatagttaatgtggctaaattgagacaggttatgcttccatcacagtatgcatattgcagtggtgacaatgagacctgtaacattttgctatgtttatgagtaaaaatgtaggagaaaaatgttgacttttcaatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctattgcaacatctatcaccacttaggagtaaaaaaaaggactaggcttacgttattatgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatgggattcttttgcccttgctctgttttgggcataagcttcttgttttgttttttcttccttttgttgtttcacttcagctagttgattgtataacctgtaaagaatttatatagaattagagacaaacactgcaaaaagtgaatcactaaaaaaaaaaaaaaaattaaccctaccttagacccctttggtgccttagagcctgtgtagtctttctgtcttcaggaaaagatgctctgactttattcacgccctttagacgactcacagatgaacctgaggaaagaaaagtgaaatcaagttgtaaacacaaggctttaaacatttcagggagttggttgaagattttaaaaattcaacatacttatagatggtttctctttaactgttttgatttgagaattttcagagacatgaattttattccttatttctttctgcctctggtgggatctctccataaatgattttttcctctttataaatgcttcttgtaagctccctggtacaggtgtaagcctgcgaggggtttctgctgggggaaaagaaatttatgacagaaataggcaaagtatctactttccattagaagtgtggaggccgtccaaggcttacctgtagatgctgtccttggtttttctatggaaagttctgatacagctggataatctgaggcttctgttgctgatacaagaggcagaaactcactcacctaatggcaagaaagttgcatgttttactctttttaaacgctttaagcgggtcttgctctgctgtcagattagagtgcagcggcatgatcacacctcactgcagcctcaatcttagctgggtctacagagacccgccaccatgcctgatttttgtattttttgtagggattgggttttgccttgttgcccaggctggtcttgaactgggcttaggctccactgccctcacacctctaggcctctgtttagatagctttattcttattgcctccctactcccctagtaaaattaccagttgttctgaagtcatttttcaatatctgggaataagtttaggtaaaacttccaacttggcactataacactaggtgtataagattagttctgccagtcttggagacaggcataaattggagtggggattaaaagaaaatgcacaatggttgacagaatagtgaaggtttaagacaaattgagagctggtgggggtgtcggcttagttaaatgcatagcataattccctccaatgagtaccttctgataagttgtaagagacaaatcaactggtttgcttgtaatagaataaaatagaaggaaagcttaaatttacctgaaagaagcattttgcttcattctcgctcttctcttctagggttaaatttgcaaaatccatttcagcaatactggtatcagtggtgcttattaaagtaagttctggttcttccattataccatggccagtttctgtttcctgtgaaccacaattaaaaggaaaaccatgtcaaaatagccttaaaagacttaaactaatcgttttgtatataatgcacattttttgcaagtgtatataaatgtgaaaatggaggaagaaaagcaatgattggcaaagaccaacagatcagatttccttaggcttccataactccagcattcagttgtagaaatactggagcctactttggggaggggatgaaatagtgtgacaatggactgaaaggtatctaccacaatgattacaaacctaaatgcttgtagtgttgggcaaaaaatataaatgcaggttggctgtgccgaattgtatcctttaaagggagcaggggtcgactgggctgctaccaaatgtgggccactgactgctaacagataatgtttcaaaagtatctaaacacaacaagaacaaaagcagccacataaaacgtggtttagttgtaattcttattttcaatctgttatgtttatttgtggaaggataaactgcacatactgctagatgaaaaccagtcaccagttgactggtgttgaaagcaagcagattataagttgcttaatatgaggagcaggtttccaatacttattccaataatggatgaattcattgcactggaatgaggctcaacactgaaagtgctgaagcacaggcagaaccaccatttttcagggaagttggagaaaggatatctgaattgggagaaaaaggatcttttgtaaaatactctcagaagacagttttcaaatttttaagtttctgcattatgctggatatttctagtgatcacaagctggatagcaatattaacaagcagttttgcttgtattttgtttcaggtttttcctgccaggcattgtggtgtgtccaaactacttcggaagttgaggcaggaggatcccttgatcctaggagtttgagttcagcctgggtagcatagtgggaacttcatctctaattttagaagaaaaaagttttttcccaaaaaggaatttaaatgttatttatacaacactgatttcacttacccagactggtatagagctctgtaatgaaaatgatccagaacttgcaaaaagctctgattctcctagttgagatagttttttggtgatttttggaatgtctgtttcagctgaattctcaaaatatttttcattttgagtagttaaggaatatggtgcctgaattgaagttcccatctccactgttcttacacataatcgagagtcagtttcctctacctgtggatttatgtctaaaaccctacaggtttcatttttattatcttcaatgagtccttgactttgtaacattgtaacaacccctctttttgatagttcttcaaagcccatactttcctttctgctttctagttggtgttttgttgagcactcactagagttagaaccacatggagtgctatgctgtacatttaactgatcaaatacattagcttcatcagatgaactgtagactgaacttaagtttcctatagaaagctggaaatgaacaatttttttcttgttttgtaatatttcagtatgttcttcagagggatagttctgatttttcatgccttgggaagaatctcttgcttcaatgctaaaaatacttggtagatcagcatgctggctctcctcctgtgaagaatattctggctgaagctgttcaaaacattgttcagatcctgcattaagaaattcaaaaatcagttaatcatcgttacatgttgtaaaagttggatactgacagtctctaatagtttatcatccaattgcaagtaacctacaattttaggcataaaagttgatgtgtataaacatgaatacaaagataaggatggtcacagtgatttctcaaactacagctcacaccaagtattttttctttttctattaatatttaataaggacaatatggctataaactgaggatgttttcctctataagaactgaatatgactttaataacagaaaagagaataaagcatccatgtgtatctcaattatccatgtgtgtatatataatttgtacatccttgtgtatctcatgtatgtttgtgtgtatatataatcatttgtaccaaaggctcaagaatacttgttttctatgttgcccaggctggtcttgaactcctgggctccagggatcctcctgccgcagcttcccaaagtgctaggattacaggcgtgagccactatacttggcctaagaagaatacttaaactggctgggcatggtggctcacacctgtaatcccagcactttgggaggccaagacgagtggatcatctgaggtcgggagttctagaccagcctgaccaacatagtgaaaccctgtctatactaaaaatagaaaattagctgggtgtggtggcacatgcctgtaatcccagctacttgggaggctgagtgaggcaggagaatcacttgaacccagcaggcggaggttgcagtgagccaagattgcaccactgcactccagcctgggcaacaagagtgaaactcagtcttcaaaaacaaaataaaaacaaaaacaaaaacaaaaaaaacaaacaaaaaaataatacttaaactgttaactatcacataatgattgaggtagggaaattgaggaacaagaggcaacacttttccttttatttcataatgttcagtattgtttaaaaaaatgcatgtattacttctgtaatttaaatattttttaacacccaggataggggtgagagcaggggtgaagacaaaccaagaggtgctaggcttaatttctaaggaaatggatgtaaaaaatcatggaaaaattaactttttctaacttagtcatacatacccccaataatattttctgtagcaaaactgtgagctccaacatgagccaagttagtgtcaggttgttgattcggacttgtgttaagagaagaatgcatgctggtcctcctcagtgctgtgaaataaactgtacttttggataatccagtagcacagtggctttcagatgaagaatctgatctctggcaggaaacaaaagggaaaggctgaaatactgattaggtattaacaattgaaacaataatcattgtgttcctttggtattactcttccttaattatcacttcactatgacagcaatgatttgctttttcaaatccagttcttttcaatcaatatgaaagagactttaaaatgtcaggccatcaggaagtggaagcaaaaagactcaggtttaaatctcagctcctttgactgtgtaggaggatactttaaattttgcaaaattgtatttactttactgtttaaatatgttccacaactaaaagttgttattaagccttttatggcatcatactccctaggtggagacaggtggatgggacaaacaaaattctaatgtagctgttttcctttttttttttttgagatggggtctcactatgttgtccaggctggagtgcagtggcacgatctcggctcactgcaacctctgcctcccaggttcaagcggttctcagcctcccgagtagctgggactacaggcatgccatcacacccaactaatttttgtgttttttagtagagatgggatttcaccatgttggccaggctgatctcaaactcctggcctcaagcaatccacctgcctcagactcccaaagtgctgggattacaggcatgagccaccgcacccggcccaatgcagctgttttcaaagttggttccacattagaatcacttggggagcttaaaaaataataataataattagtactatctgagcactcccagaaactctgctttaattggtctagggtgtagtctggacaataggatttatttttattttttatttaagttttccatgtgattctttttgtttgtttgtttgtttctttttttaaagacagggtctggctctgtcacccagactggagtgtagtggcacgatctcagctcactgcagcctccacctcctgggctcaagtggtcctcccacctcagcctcccgagtagctgggactacaggtgcgcaccacgacacctggctaatttttgtattttcagtagagacagggttttgccatgttggccaggctggtctcgaactcttggcctcaagtaatctgcccgccttgggctctcaaagtgctgggattacaggtgtgagccactgtgcccagacttccatgtgattctaggtaagggtttagaagaacttttgttccagtagaagaaatggcttaaaactatttttagatattcactgcaatgggacatctactttaatatacctggtaaaagtctctgttgtctggagaaatcccagaggatgatgatgataagtcaaaatctggatgtggttctaagggtttaaacagctgatgatgcaaattaggaaaaatgtgttccaattctggaaagtcaaggtcaactgttagaatttttgagggaaaaaaatcataaatttatttttaaggtaaacactagaaaaggagtattaagaacatattcataaacgcttattttcaggtaactccagtgtaacaaaaacttcagtttttcccccatgatcagcagatgctttaaagttaagtcctatcatgattatttcaaaggtccaaaatatggatcctctcagtgaccaaaactttttaagttttatttttagagaaatttaatttttttaaatttaaaaaatttttttttaaaatagagatggggtctcagtgttgcccaggctggtcttgaaatcctgggctcaagcaatcctcctgcctcagcctcccaaagtgctacgattacaggtatgaacaaacttttgacaaatacgaatttccatttccacagccttatgaggctaatgaggatcaacaggacatatgtaaccactgcttcagtataagcttaaaaaaggaaaaaggctcactgtattcagtgttactatgggccagacattgtgctttatgtgcactatctcatttaatctataatattcctcttttataaaagattaaaaagtaacttgcccatggttttacagctaggaaatggtcaggctatgactcaaatccagaactgtatgatttctgagctcctgctcttatttatcagtaataccgcctcagccgtaatagctaactctgcaatggcaaaggaagatttgctaattaatctcctataaatgtgcctcagtgagtctaattggttccagatcccctttctcactaaatgccctcaatatattctgtggtaaaacggtgttgtagcaggccataagaacatgaagctcaaacaatcactgcataaaatttaaaatgatgaaaggtgaaaatttaaaacttaatttacataaaagtattgctttaaaataattttaccttgcaaatctgttttttcaggtatcaaatttgcttcattaatgtacttgtctatcatttgctgaaagtgtgtgtgaccacatgtagtttcatccactgcaggcaacagagatttatgaacgtctgaagagttctgccgctgataaatatcttgtgttgaaggaactatggaacttataatatttgtttcctc

SEQ ID NO: 9035 - DNA, 16285 bp, Homo sapiens
gtcaatatttagggaagctttgtcatatttactaaatttcataatttcagaaaactgtttaaaacaaagagcaattgatggataaatcaggaatagattctcttgaccatgtgacatctgatgctgtggaacttgcaaatcgaaggtgagtggattcaatcatgtttattgtatctgaattatgagaaactattgtatataatgagtgacagtaaagataattttcaggaattgggaaagaaggaaaactagatttcactgaccttccaagtttatctagttacatagattgatataatagcattgcaaatactttaaattcaaaatgtgaatatattatgggacacattcgtcgagaaaaaatgtattctttgggtcatattagcatctcttccagactacatcctccggttcggtaggctgtgtttgttttactcagacactcttagcagtgaaccgaaccatacagccttttggagctcatacattgtcttgaaagatacagtttttttgtaagctgagcatagtggtgcatgccattagtcctagctagctacttgggaggctgaggcaggagcatccctggagtttccaggagtttgaggttgcagtgagctgtgattgcaccactgcactccagtctgggtgacagcaagacgatgtctacaaaactctttaataagagctgtagcattatgggctatttaaataggatgatcagtagaaaggctagctggttctgagcccatcctttaaaaaatttttaattctgggcatgttttctgagttggtcttggaagaaatgtacatttaggactgggtattaatggtaataagcagtaagaaaagaagatgaaattaatttttttcccatttttctagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgaggtgagtcagcattttacatacatggctacacataactcaagatgcccaaaatgatttgttggccaatttagaattgtctcagatatactgggaacagactgtctgcaattttgatactcttctatactgacttacccctaaagtccaccctatccttcaactgaatcttgacttgtatctcttaatataactacactttgccatatttaaaagatagtgctccaaggctctttgtataaaatcctttgatcttatcccatctcaggtctttaaacacaaccctaaaactcagtggggataataaaagctcacataacttgaaattacttttgcagtaacctaaactaaaaccacacatgccttatgttcagtggatatattcttaaggcctagatgtttctaagccaattatctgaaaaatacgctaatacttaggagtagacttttttaaatatttgagagttgtatgttgaatgaattcagaattaatttatgatcccttgccagaacctgaaattttatttgggaggattaatacatgttaatctcttcagttaatctcttaagtttaaggtgattatagtaaacattagaaatcttattcctgtttttacattttaaaatgcctttagtaagtcccagacatgacaagatatgtacttcacttttccatgttaccagcttaggtaaattcataattgtaatgtgaattttaataatcagcatttgataagtccacaagtggggagtagttaagatagcaaattcagagtctttgctaagggggggcattgccctttttgaacataggcacctgctgggtcttaaaaataaaatctcgacatacttatggtgtttttaatatatagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgtaagtggaatcatatgaaatactttggtaataggttataaattaaatttctatgttaattgcttcatattttgcctttaatatagttatacttaaataatgaacaaagatacagagtatgacaattgggattattacagttgagccaagcttggcacaccgttcatctagaattctccagaacacaaaattctcaaattttgtgtttcctttgactagtattgcagtttcagttatatttcagagtggaatatacaactaattaggtcatcgaagattctgtcatctcgatgataaattttaatattacagagcagaggatgaggatgcaacacatcttgaagataacgaatgtgatatcaaattggcagtaagtgacttatttttttcctattccattttgggaaggcaggagttggttgatacagaaggaattatatttagtttttctcttacacttcatttaacttttgaaaagctctataagtttactgcaggaaatgcaagaaggaaaataattttttagagacttgataaagaacatggggttttcagtactatttttaataagtagcattctgatacatattattgctagttaggatgtcaaatgaaaaaataagcaatgttaatttggatttttaacatctacatgtagtctctaggttatctgaagtaatccagggcattcagctatatgtaattactaaactatttgagttattgcttaatccatgattttttgtttgttttatgcagggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaatttcatgttgatgatatacacaatggctttttgttttaaaggcttttatcttgagaacatggtgtctggagttaaaggtatgtctcaatttgagttttcacatcatatttgtttatgtgtaggaaacagtatgttgtcagagcaagtttcattttattcagggacatttctaccatgcttttaattcccatttatactgatttctgaaaagaagaatcctagattcacacattttatagtgatgtgtcagattcattttagttgcaagcattagagggtcctgaatttgttagtttgtagcaataatcagaactttggatttcctacttgaagcctacagcattattttgaattaatgcacaatctaaaatgaggcagaggattttatggtttaatgcaaaatatagtataataaaagatgattacacaggtcataagaattcataaatttgaatgatgtagagtttgattaaaagttatataatgccaaagtcgtaacttacaggcacattatattcctgtattttataatggatgacaattaattttgagccaagaattaaaatttgctgaaatcttcgaattgggaaaacaacatcctctgttgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatccatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataacttgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggtaagattctctgtttctattgattctgcttgtttccctctatcagtagcactgccagcataacaagaacttcgtacaaatacactactaagctttaaagacttttacaatgcctcattctagagaatgggcactgttgatcatggtgtccaaaaatagttaatgtggctaaattgagacaggttatgcttccatcacagtatgcatattgcagtggtgacaatgagacctgtaacattttgctatgtttatgagtaaaaatgtaggagaaaaatgttgacttttcaatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctattgcaacatctatcaccacttaggagtaaaaaaaaggactaggcttacgttattatgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcactaaaaaaaaaaaaaaaattaaccctaccttagacccctttggtgccttagagcctgtgtagtctttctgtcttcaggaaaagatgctctgactttattcacgccctttagacgactcacagatgaacctgaggaaagaaaagtgaaatcaagttgtaaacacaaggctttaaacatttcagggagttggttgaagattttaaaaattcaacatacttatagatggtttctctttaactgttttgatttgagaattttcagagacatgaattttattccttatttctttctgcctctggtgggatctctccataaatgattttttcctctttataaatgcttcttgtaagctccctggtacaggtgtaagcctgcgaggggtttctgctgggggaaaagaaatttatgacagaaataggcaaagtatctactttccattagaagtgtggaggccgtccaaggcttacctgtagatgctgtccttggtttttctatggaaagttctgatacagctggataatctgaggcttctgttgctgatacaagagcagaaactcactcacctaatggcaagaaagttgcatgttttactctttttaaacgctttaagcgggtcttgctctgctgtcagattagagtgcagcggcatgatcacacctcactgcagcctcaatcttagctgggtctacagagacccgccaccatgcctgatttttgtattttttgtagggattgggttttgccttgttgcccaggctggtcttgaactgggcttaggctccactgccctcacacctctaggcctctgtttagatagctttattcttattgcctccctactcccctagtaaaattaccagttgttctgaagtcatttttcaatatctgggaataagtttaggtaaaacttccaacttggcactataacactaggtgtataagattagttctgccagtcttggagacaggcataaattggagtggggattaaaagaaaatgcacaatggttgacagaatagtgaaggtttaagacaaattgagagctggtgggggtgtcggcttagttaaatgcatagcataattccctccaatgagtaccttctgataagttgtaagagacaaatcaactggtttgcttgtaatagaataaaatagaaggaaagcttaaatttacctgaaagaagcattttgcttcattctcgctcttctcttctagggttaaatttgcaaaatccatttcagcaatactggtatcagtggtgcttattaaagtaagttctggttcttccattataccatggccagtttctgtttcctgtgaaccacaattaaaaggaaaaccatgtcaaaatagccttaaaagacttaaactaatcgttttgtatataatgcacattttttgcaagtgtatataaatgtgaaaatggaggaagaaaagcaatgattggcaaagaccaacagatcagatttccttaggcttccataactccagcattcagttgtagaaatactggagcctactttggggaggggatgaaatagtgtgacaatggactgaaaggtatctaccacaatgattacaaacctaaatgcttgtagtgttgggcaaaaaatataaatgcaggttggctgtgccgaattgtatcctttaaagggagcaggggtcgactgggctgctaccaaatgtgggccactgactgctaacagataatgtttcaaaagtatctaaacacaacaagaacaaaagcagccacataaaacgtggtttagttgtaattcttattttcaatctgttatgtttatttgtggaaggataaactgcacatactgctagatgaaaaccagtcaccagttgactggtgttgaaagcaagcagattataagttgcttaatatgaggagcaggtttccaatacttattccaataatggatgaattcattgcactggaatgaggctcaacactgaaagtgctgaagcacaggcagaaccaccatttttcagggaagttggagaaaggatatctgaattgggagaaaaaggatcttttgtaaaatactctcagaagacagttttcaaatttttaagtttctgcattatgctggatatttctagtgatcacaagctggatagcaatattaacaagcagttttgcttgtattttgtttcaggtttttcctgccaggcattgtggtgtgtccaaactacttcggaagttgaggcaggaggatcccttgatcctaggagtttgagttcagcctgggtagcatagtgggaacttcatctctaattttagaagaaaaaagttttttcccaaaaaggaatttaaatgttatttatacaacactgatttcacttacccagactggtatagagctctgtaatgaaaatgatccagaacttgcaaaaagctctgattctcctagttgagatagttttttggtgatttttggaatgtctgtttcagctgaattctcaaaatatttttcattttgagtagttaaggaatatggtgcctgaattgaagttcccatctccactgttcttacacataatcgagagtcagtttcctctacctgtggatttatgtctaaaaccctacaggtttcatttttattatcttcaatgagtccttgactttgtaacattgtaacaacccctctttttgatagttcttcaaagcccatactttcctttctgctttctagttggtgttttgttgagcactcactagagttagaaccacatggagtgctatgctgtacatttaactgatcaaatacattagcttcatcagatgaactgtagactgaacttaagtttcctatagaaagctggaaatgaacaatttttttcttgttttgtaatatttcagtatgttcttcagagggatagttctgatttttcatgccttgggaagaatctcttgcttcaatgctaaaaatacttggtagatcagcatgctggctctcctcctgtgaagaatattctggctgaagctgttcaaaacattgttcagatcctgcattaagaaattcaaaaatcagttaatcatcgttacatgttgtaaaagttggatactgacagtctctaatagtttatcatccaattgcaagtaacctacaattttaggcataaaagttgatgtgtataaacatgaatacaaagataaggatggtcacagtgatttctcaaactacagctcacaccaagtattttttctttttctattaatatttaataaggacaatatggctataaactgaggatgttttcctctataagaactgaatatgactttaataacagaaaagagaataaagcatccatgtgtatctcaattatccatgtgtgtatatataatttgtacatccttgtgtatctcatgtatgtttgtgtgtatatataatcatttgtaccaaaggctcaagaatacttgttttctatgttgcccaggctggtcttgaactcctgggctccagggatcctcctgccgcagcttcccaaagtgctaggattacaggcgtgagccactatacttggcctaagaagaatacttaaactggctgggcatggtggctcacacctgtaatcccagcactttgggaggccaagacgagtggatcatctgaggtcgggagttctagaccagcctgaccaacatagtgaaaccctgtctatactaaaaatagaaaattagctgggtgtggtggcacatgcctgtaatcccagctacttgggaggctgagtgaggcaggagaatcacttgaacccagcaggcggaggttgcagtgagccaagattgcaccactgcactccagcctgggcaacaagagtgaaactcagtcttcaaaaacaaaataaaaacaaaaacaaaaacaaaaaaaacaaacaaaaaaataatacttaaactgttaactatcacataatgattgaggtagggaaattgaggaacaagaggcaacacttttccttttatttcataatgttcagtattgtttaaaaaaatgcatgtattacttctgtaatttaaatattttttaacacccaggataggggtgagagcaggggtgaagacaaaccaagaggtgctaggcttaatttctaaggaaatggatgtaaaaaatcatggaaaaattaactttttctaacttagtcatacatacccccaataatattttctgtagcaaaactgtgagctccaacatgagccaagttagtgtcaggttgttgattcggacttgtgttaagagaagaatgcatgctggtcctcctcagtgctgtgaaataaactgtacttttggataatccagtagcacagtggctttcagatgaagaatctgatctctggcaggaaacaaaagggaaaggctgaaatactgattaggtattaacaattgaaacaataatcattgtgttcctttggtattactcttccttaattatcacttcactatgacagcaatgatttgctttttcaaatccagttcttttcaatcaatatgaaagagactttaaaatgtcaggccatcaggaagtggaagcaaaaagactcaggtttaaatctcagctcctttgactgtgtaggaggatactttaaattttgcaaaattgtatttactttactgtttaaatatgttccacaactaaaagttgttattaagccttttatggcatcatactccctaggtggagacaggtggatgggacaaacaaaattctaatgtagctgttttcctttttttttttttgagatggggtctcactatgttgtccaggctggagtgcagtggcacgatctcggctcactgcaacctctgcctcccaggttcaagcggttctcagcctcccgagtagctgggactacaggcatgccatcacacccaactaatttttgtgttttttagtagagatgggatttcaccatgttggccaggctgatctcaaactcctggcctcaagcaatccacctgcctcagactcccaaagtgctgggattacaggcatgagccaccgcacccggcccaatgcagctgttttcaaagttggttccacattagaatcacttggggagcttaaaaaataataataataattagtactatctgagcactcccagaaactctgctttaattggtctagggtgtagtctggacaataggatttatttttattttttatttaagttttccatgtgattctttttgtttgtttgtttgtttctttttttaaagacagggtctggctctgtcacccagactggagtgtagtggcacgatctcagctcactgcagcctccacctcctgggctcaagtggtcctcccacctcagcctcccgagtagctgggactacaggtgcgcaccacgacacctggctaatttttgtattttcagtagagacagggttttgccatgttggccaggctggtctcgaactcttggcctcaagtaatctgcccgccttgggctctcaaagtgctgggattacaggtgtgagccactgtgcccagacttccatgtgattctaggtaagggtttagaagaacttttgttccagtagaagaaatggcttaaaactatttttagatattcactgcaatgggacatctactttaatatacctggtaaaagtctctgttgtctggagaaatcccagaggatgatgatgataagtcaaaatctggatgtggttctaagggtttaaacagctgatgatgcaaattaggaaaaatgtgttccaattctggaaagtcaaggtcaactgttagaatttttgagggaaaaaaatcataaatttatttttaaggtaaacactagaaaaggagtattaagaacatattcataaacgcttattttcaggtaactccagtgtaacaaaaacttcagtttttcccccatgatcagcagatgctttaaagttaagtcctatcatgattatttcaaaggtccaaaatatggatcctctcagtgaccaaaactttttaagttttatttttagagaaatttaatttttttaaatttaaaaaatttttttttaaaatagagatggggtctcagtgttgcccaggctggtcttgaaatcctgggctcaagcaatcctcctgcctcagcctcccaaagtgctacgattacaggtatgaacaaacttttgacaaatacgaatttccatttccacagccttatgaggctaatgaggatcaacaggacatatgtaaccactgcttcagtataagcttaaaaaaggaaaaaggctcactgtattcagtgttactatgggccagacattgtgctttatgtgcactatctcatttaatctataatattcctcttttataaaagattaaaaagtaacttgcccatggttttacagctaggaaatggtcaggctatgactcaaatccagaactgtatgatttctgagctcctgctcttatttatcagtaataccgcctcagccgtaatagctaactctgcaatggcaaaggaagatttgctaattaatctcctataaatgtgcctcagtgagtctaattggttccagatcccctttctcactaaatgccctcaatatattctgtggtaaaacggtgttgtagcaggccataagaacatgaagctcaaacaatcactgcataaaatttaaaatgatgaaaggtgaaaatttaaaacttaatttacataaaagtattgctttaaaataattttaccttgcaaatctgttttttcaggtatcaaatttgcttcattaatgtacttgtctatcatttgctgaaagtgtgtgtgaccacatgtagtttcatccactgcaggcaacagagatttatgaacgtctgaagagttctgccgctgataaatatcttgtgttgaaggaactatggaacttataatatttgtttcctc

SEQ ID NO: 9036 - DNA, 16281 bp, Homo sapiens
gtcaatatttagggaagctttgtcatatttactaaatttcataatttcagaaaactgtttaaaacaaagagcaattgatggataaatcaggaatagattctcttgaccatgtgacatctgatgctgtggaacttgcaaatcgaaggtgagtggattcaatcatgtttattgtatctgaattatgagaaactattgtatataatgagtgacagtaaagataattttcaggaattgggaaagaaggaaaactagatttcactgaccttccaagtttatctagttacatagattgatataatagcattgcaaatactttaaattcaaaatgtgaatatattatgggacacattcgtcgagaaaaaatgtattctttgggtcatattagcatctcttccagactacatcctccggttcggtaggctgtgtttgttttactcagacactcttagcagtgaaccgaaccatacagccttttggagctcatacattgtcttgaaagatacagtttttttgtaagctgagcatagtggtgcatgccattagtcctagctagctacttgggaggctgaggcaggagcatccctggagtttccaggagtttgaggttgcagtgagctgtgattgcaccactgcactccagtctgggtgacagcaagacgatgtctacaaaactctttaataagagctgtagcattatgggctatttaaataggatgatcagtagaaaggctagctggttctgagcccatcctttaaaaaatttttaattctgggcatgttttctgagttggtcttggaagaaatgtacatttaggactgggtattaatggtaataagcagtaagaaaagaagatgaaattaatttttttcccatttttctagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgaggtgagtcagcattttacatacatggctacacataactcaagatgcccaaaatgatttgttggccaatttagaattgtctcagatatactgggaacagactgtctgcaattttgatactcttctatactgacttacccctaaagtccaccctatccttcaactgaatcttgacttgtatctcttaatataactacactttgccatatttaaaagatagtgctccaaggctctttgtataaaatcctttgatcttatcccatctcaggtctttaaacacaaccctaaaactcagtggggataataaaagctcacataacttgaaattacttttgcagtaacctaaactaaaaccacacatgccttatgttcagtggatatattcttaaggcctagatgtttctaagccaattatctgaaaaatacgctaatacttaggagtagacttttttaaatatttgagagttgtatgttgaatgaattcagaattaatttatgatcccttgccagaacctgaaattttatttgggaggattaatacatgttaatctcttcagttaatctcttaagtttaaggtgattatagtaaacattagaaatcttattcctgtttttacattttaaaatgcctttagtaagtcccagacatgacaagatatgtacttcacttttccatgttaccagcttaggtaaattcataattgtaatgtgaattttaataatcagcatttgataagtccacaagtggggagtagttaagatagcaaattcagagtctttgctaagggggggcattgccctttttgaacataggcacctgctgggtcttaaaaataaaatctcgacatacttatggtgtttttaatatatagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgtaagtggaatcatatgaaatactttggtaataggttataaattaaatttctatgttaattgcttcatattttgcctttaatatagttatacttaaataatgaacaaagatacagagtatgacaattgggattattacagttgagccaagcttggcacaccgttcatctagaattctccagaacacaaaattctcaaattttgtgtttcctttgactagtattgcagtttcagttatatttcagagtggaatatacaactaattaggtcatcgaagattctgtcatctcgatgataaattttaatattacagagcagaggatgaggatgcaacacatcttgaagataacgaatgtgatatcaaattggcagtaagtgacttatttttttcctattccattttgggaaggcaggagttggttgatacagaaggaattatatttagtttttctcttacacttcatttaacttttgaaaagctctataagtttactgcaggaaatgcaagaaggaaaataattttttagagacttgataaagaacatggggttttcagtactatttttaataagtagcattctgatacatattattgctagttaggatgtcaaatgaaaaaataagcaatgttaatttggatttttaacatctacatgtagtctctaggttatctgaagtaatccagggcattcagctatatgtaattactaaactatttgagttattgcttaatccatgattttttgtttgttttatgcagggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaatttcatgttgatgatatacacaatggctttttgttttaaaggcttttatcttgagaacatggtgtctggagttaaaggtatgtctcaatttgagttttcacatcatatttgtttatgtgtaggaaacagtatgttgtcagagcaagtttcattttattcagggacatttctaccatgcttttaattcccatttatactgatttctgaaaagaagaatcctagattcacacattttatagtgatgtgtcagattcattttagttgcaagcattagagggtcctgaatttgttagtttgtagcaataatcagaactttggatttcctacttgaagcctacagcattattttgaattaatgcacaatctaaaatgaggcagaggattttatggtttaatgcaaaatatagtataataaaagatgattacacaggtcataagaattcataaatttgaatgatgtagagtttgattaaaagttatataatgccaaagtcgtaacttacaggcacattatattcctgtattttataatggatgacaattaattttgagccaagaattaaaatttgctgaaatcttcgaattgggaaaacaacatcctctgttgcatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggtaagattctctgtttctattgattctgcttgtttccctctatcagtagcactgccagcataacaagaacttcgtacaaatacactactaagctttaaagacttttacaatgcctcattctagagaatgggcactgttgatcatggtgtccaaaaatagttaatgtggctaaattgagacaggttatgcttccatcacagtatgcatattgcagtggtgacaatgagacctgtaacattttgctatgtttatgagtaaaaatgtaggagaaaaatgttgacttttcaatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctatgcaacatctatcaccacttaggagtaaaaaaaaggactaggcttacgttattatgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcactaaaaaaaaaaaaaaaattaaccctaccttagacccctttggtgccttagagcctgtgtagtctttctgtcttcaggaaaagatgctctgactttattcacgccctttagacgactcacagatgaacctgaggaaagaaaagtgaaatcaagttgtaaacacaaggctttaaacatttcagggagttggttgaagattttaaaaattcaacatacttatagatggtttctctttaactgttttgatttgagaattttcagagacatgaattttattccttatttctttctgcctctggtgggatctctccataaatgattttttcctctttataaatgcttcttgtaagctccctggtacaggtgtaagcctgcgaggggtttctgctgggggaaaagaaatttatgacagaaataggcaaagtatctactttccattagaagtgtggaggccgtccaaggcttacctgtagatgctgtccttggtttttctatggaaagttctgatacagctggataatctgaggcttctgttgctgatacaagaggcagaaactcactcacctaatggcaagaaagttgcatgttttactctttttaaacgctttaagcgggtcttgctctgctgtcagattagagtgcagcggcatgatcacacctcactgcagcctcaatcttagctgggtctacagagacccgccaccatgcctgatttttgtattttttgtagggattgggttttgccttgttgcccaggctggtcttgaactgggcttaggctccactgccctcacacctctaggcctctgtttagatagctttattcttattgcctccctactcccctagtaaaattaccagttgttctgaagtcatttttcaatatctgggaataagtttaggtaaaacttccaacttggcactataacactaggtgtataagattagttctgccagtcttggagacaggcataaattggagtggggattaaaagaaaatgcacaatggttgacagaatagtgaaggtttaagacaaattgagagctggtgggggtgtcggcttagttaaatgcatagcataattccctccaatgagtaccttctgataagttgtaagagacaaatcaactggtttgcttgtaatagaataaaatagaaggaaagcttaaatttacctgaaagaagcattttgcttcattctcgctcttctcttctagggttaaatttgcaaaatccatttcagcaatactggtatcagtggtgcttattaaagtaagttctggttcttccattataccatggccagtttctgtttcctgtgaaccacaattaaaaggaaaaccatgtcaaaatagccttaaaagacttaaactaatcgttttgtatataatgcacattttttgcaagtgtatataaatgtgaaaatggaggaagaaaagcaatgattggcaaagaccaacagatcagatttccttaggcttccataactccagcattcagttgtagaaatactggagcctactttggggaggggatgaaatagtgtgacaatggactgaaaggtatctaccacaatgattacaaacctaaatgcttgtagtgttgggcaaaaaatataaatgcaggttggctgtgccgaattgtatcctttaaagggagcaggggtcgactgggctgctaccaaatgtgggccactgactgctaacagataatgtttcaaaagtatctaaacacaacaagaacaaaagcagccacataaaacgtggtttagttgtaattcttattttcaatctgttatgtttatttgtggaaggataaactgcacatactgctagatgaaaaccagtcaccagttgactggtgttgaaagcaagcagattataagttgcttaatatgaggagcaggtttccaatacttattccaataatggatgaattcattgcactggaatgaggctcaacactgaaagtgctgaagcacaggcagaaccaccatttttcagggaagttggagaaaggatatctgaattgggagaaaaaggatcttttgtaaaatactctcagaagacagttttcaaatttttaagtttctgcattatgctggatatttctagtgatcacaagctggatagcaatattaacaagcagttttgcttgtattttgtttcaggtttttcctgccaggcattgtggtgtgtccaaactacttcggaagttgaggcaggaggatcccttgatcctaggagtttgagttcagcctgggtagcatagtgggaacttcatctctaattttagaagaaaaaagttttttcccaaaaaggaatttaaatgttatttatacaacactgatttcacttacccagactggtatagagctctgtaatgaaaatgatccagaacttgcaaaaagctctgattctcctagttgagatagttttttggtgatttttggaatgtctgtttcagctgaattctcaaaatatttttcattttgagtagttaaggaatatggtgcctgaattgaagttcccatctccactgttcttacacataatcgagagtcagtttcctctacctgtggatttatgtctaaaaccctacaggtttcatttttattatcttcaatgagtccttgactttgtaacattgtaacaacccctctttttgatagttcttcaaagcccatactttcctttctgctttctagttggtgttttgttgagcactcactagagttagaaccacatggagtgctatgctgtacatttaactgatcaaatacattagcttcatcagatgaactgtagactgaacttaagtttcctatagaaagctggaaatgaacaatttttttcttgttttgtaatatttcagtatgttcttcagagggatagttctgatttttcatgccttgggaagaatctcttgcttcaatgctaaaaatacttggtagatcagcatgctggctctcctcctgtgaagaatattctggctgaagctgttcaaaacattgttcagatcctgcattaagaaattcaaaaatcagttaatcatcgttacatgttgtaaaagttggatactgacagtctctaatagtttatcatccaattgcaagtaacctacaattttaggcataaaagttgatgtgtataaacatgaatacaaagataaggatggtcacagtgatttctcaaactacagctcacaccaagtattttttctttttctattaatatttaataaggacaatatggctataaactgaggatgttttcctctataagaactgaatatgactttaataacagaaaagagaataaagcatccatgtgtatctcaattatccatgtgtgtatatataattgtacatccttgtgtatctcatgtatgtttgtgtgtatatataatcattgtaccaaaggctcaagaatacttgttttctatgttgcccaggctggtcttgaactcctgggctccagggatcctcctgccgcagcttcccaaagtgctaggattacaggcgtgagccactatacttggcctaagaagaatacttaaactggctgggcatggtggctcacacctgtaatcccagcactttgggaggccaagacgagtggatcatctgaggtcgggagttctagaccagcctgaccaacatagtgaaaccctgtctatactaaaaatagaaaattagctgggtgtggtggcacatgcctgtaatcccagctacttgggaggctgagtgaggcaggagaatcacttgaacccagcaggcggaggttgcagtgagccaagattgcaccactgcactccagcctgggcaacaagagtgaaactcagtcttcaaaaacaaaataaaaacaaaaacaaaaacaaaaaaaacaaacaaaaaaataaatacttaaactgttaactatcacataatgattgaggtagggaaattgaggaacaagaggcaacacttttccttttatttcataatgttcagtattgtttaaaaaaatgcatgtattacttctgtaatttaaatattttttaacacccaggataggggtgagagcaggggtgaagacaaaccaagaggtgctaggcttaatttctaaggaaatggatgtaaaaaatcatggaaaaattaactttttctaacttagtcatacatacccccaataatattttctgtagcaaaactgtgagctccaacatgagccaagttagtgtcaggttgttgattcggacttgtgttaagagaagaatgcatgctggtcctcctcagtgctgtgaaataaactgtacttttggataatccagtagcacagtggctttcagatgaagaatctgatctctggcaggaaacaaaagggaaaggctgaaatactgattaggtattaacaattgaaacaataatcattgtgttcctttggtattactcttccttaattatcacttcactatgacagcaatgatttgctttttcaaatccagttcttttcaatcaatatgaaagagactttaaaatgtcaggccatcaggaagtggaagcaaaaagactcaggtttaaatctcagctcctttgactgtgtaggaggatactttaaattttgcaaaattgtatttactttactgtttaaatatgttccacaactaaaagttgttattaagccttttatggcatcatactccctaggtggagacaggtggatgggacaaacaaaattctaatgtagctgttttcctttttttttttttgagatggggtctcactatgttgtccaggctggagtgcagtggcacgatctcggctcactgcaacctctgcctcccaggttcaagcggttctcagcctcccgagtagctgggactacaggcatgccatcacacccaactaatttttgtgttttttagtagagatgggatttcaccatgttggccaggctgatctcaaactcctggcctcaagcaatccacctgcctcagactcccaaagtgctgggattacaggcatgagccaccgcacccggcccaatgcagctgttttcaaagttggttccacattagaatcacttggggagcttaaaaaataataataataattagtactatctgagcactcccagaaactctgctttaattggtctagggtgtagtctggacaataggatttatttttattttttatttaagttttccatgtgattctttttgtttgtttgtttgtttctttttttaaagacagggtctggctctgtcacccagactggagtgtagtggcacgatctcagctcactgcagcctccacctcctgggctcaagtggtcctcccacctcagcctcccgagtagctgggactacaggtgcgcaccacgacacctggctaatttttgtattttcagtagagacagggttttgccatgttggccaggctggtctcgaactcttggcctcaagtaatctgcccgccttgggctctcaaagtgctgggattacaggtgtgagccactgtgcccagacttccatgtgattctaggtaagggtttagaagaacttttgttccagtagaagaaatggcttaaaactatttttagatattcactgcaatgggacatctactttaatatacctggtaaaagtctctgttgtctggagaaatcccagaggatgatgatgataagtcaaaatctggatgtggttctaagggtttaaacagctgatgatgcaaattaggaaaaatgtgttccaattctggaaagtcaaggtcaactgttagaatttttgagggaaaaaaatcataaatttatttttaaggtaaacactagaaaaggagtattaagaacatattcataaacgcttattttcaggtaactccagtgtaacaaaaacttcagtttttcccccatgatcagcagatgctttaaagttaagtcctatcatgattatttcaaaggtccaaaatatggatcctctcagtgaccaaaactttttaagttttatttttagagaaatttaatttttttaaatttaaaaaatttttttttaaaatagagatggggtctcagtgttgcccaggctggtcttgaaatcctgggctcaagcaatcctcctgcctcagcctcccaaagtgctacgattacaggtatgaacaaacttttgacaaatacgaatttccatttccacagccttatgaggctaatgaggatcaacaggacatatgtaaccactgcttcagtataagcttaaaaaaggaaaaaggctcactgtattcagtgttactatgggccagacattgtgctttatgtgcactatctcatttaatctataatattcctcttttataaaagattaaaaagtaacttgcccatggttttacagctaggaaatggtcaggctatgactcaaatccagaactgtatgatttctgagctcctgctcttatttatcagtaataccgcctcagccgtaatagctaactctgcaatggcaaaggaagatttgctaattaatctcctataaatgtgcctcagtgagtctaattggttccagatcccctttctcactaaatgccctcaatatattctgtggtaaaacggtgttgtagcaggccataagaacatgaagctcaaacaatcactgcataaaatttaaaatgatgaaaggtgaaaatttaaaacttaatttacataaaagtattgctttaaaataattttaccttgcaaatctgttttttcaggtatcaaatttgcttcattaatgtacttgtctatcatttgctgaaagtgtgtgtgaccacatgtagtttcatccactgcaggcaacagagatttatgaacgtctgaagagttctgccgctgataaatatcttgtgttgaaggaactatggaacttataatatttgtttcctc

SEQ ID NO: 9037 - DNA, 357 bp, Homo sapiens
ttctgagctcaggtcaagtgtagaaaccatcatagttacaaagatcagtagtaaaaccttttcatcattgcccagaaatgattaggctttcatagacatacatacgcacccccccaccctcaatctcattcattcctacagctgttatctttataaacacatgtgcgtacacacacacacacacacacacacacacacacacaccagacatatgcccttattgttttacattgttttatagttttgcttctcagaactgtagagatcatgcatcaggtagactggaaagacttctgatgctcagatttggctagtttcatcattgatccacttcactaaaagcagatctcagaaagc

SEQ ID NO: 9038 - DNA, 357 bp, Homo sapiens; identical to SEQ ID NO: 9037

SEQ ID NO: 9039 - DNA, 357 bp, Homo sapiens; identical to SEQ ID NO: 9037

SEQ ID NO: 9040 - DNA, 3786 bp, Homo sapiens
ctgaatctgtaaattgctttgggcagtatggccctttcaacaatattgttttttcctatccatgagcatggaatgtttttctatttgttatgtcatctctgatttctttgtgcagtgttttgtgactttcatcgtagagatcctttacctccctggttagctgtattcctagtattgtattctttttgtggctattgtgaatggaattgcattcttgatttggctgtcaccttggatgttgttggtgtataggaatactactgatttttgtacattgattttgtatcctgaaactttgccaaagttgcttatcagatcaaggagcttttgggcagagactggaattttctaggaatagaatcataacatctgaaaacaggaatagtttgacttcctctcttcctatttggatgccttttctttttttttgtctgattgctgtgtccaggacttccagtaatatgttgaattggagtggtgagagaaggcgttcttttcttgctccagttttcaaggggaaggcttccagctttgctcattcagtatgatgttggctgtgggtttgtcatagatggttcatattattttgagttatgttccttcagtgcctactttcttgagggtttttaacctgaagagatgttgaattttatggacagccttttctgcatccattgagctaatcatgtggtttttgtttttagttctgtttatgtgatgaactcacatttatttatttgtgtatgttgaaccaatcttgcatcccagggataaagcctgcttgatcatggtggagtagctttttgatgtgctgctggattcagtttgctagtattttgttgaggaccttggcatctatattttattaaggatattggccttaagtttttttgttgttgtgtctctgccaggttttggtatcagaatgattctggcctcacagaatgagttagggaggagtccctccttctcaattttttggaatagagtggtaccggctcttctttatacatctggtagaattcagctctgtcaatttctgtcaattgcctgtgttgaaatccaatgactacctcaaactatttctaatctcttttacatttttacccaaccaatttaatttcttggattcccacatattccttttttttttttttttttttttttttttttgagatggagtcttgctctgtcgccagactggagtacagtggcgcgatcttggctcacagaaacctctgcttcccaggttcaagggattctcctgcctcagcctcccaagtagctgggactacaggcatgcaccaccacacccagctaatttttgtatgtttagtagagacgtggtttcaccgtgttggccaggatggtctcgatctcttgatcttgtgatctgcctgcctcggcctcacaaagctctgggattacaagccacacattctattcttaccagcttgacaaatggagtacctactgctcattgttcttctcattggccatacctccctaccatgcttctataggtagaacaacatcaaagtatcatatgcctcaaactcaactcaggtgtttgtaaccaagcttagaatccccttcactggcccatttctgactaaaaaggaggtcatttcaggcactctctgaaacatgacctaaaaaaacccatgtccacattaaaaccacactagattttctactttatagcaaatttcattgtatcaaatatgaattttatttgaaagggcctttgattaactcgagcctgaaaatccaaagttgtatcttaacattgaaatttgtatgtataagtagactctacatcctgggaactttgggttgtattgcttatgtgttttctctttgtatgaaatagagtgaataaactattgcctatttagaaagatgatatggaggcctactctgactaggtagacatgtgctttatgttgcttttctagtgcaagagctgcagtttcatgatgcatgcacatcctgttgcctgttttgttttactacaaatggcccactgggaatattcccttcagttaagatgtactgagcacccagcatgggccaactagcatgataggcaggttagtagtgtgtgtgtgtgtgtgtgtgtgtgtgtgtgtgtaaaatacaatattatatataatatacatattatactatattttatatatatcttatatatactagatatataagatatatataaaagaaatacaacgtttgcccattatactaactgaagatacttgtgagttaggctcatcccaaactgtccagtatttgcttctcttagaaagtccaaaagcttttcatgtaacttggtgggctttctccctgacagaagcatttcacatatgcctactctctagcatgtcattcctgccacatatctcagccatgggcatctcactctcagctagtgcagcctatcttgatacctgctcagaacttggtataaacaaaactctatatacttcatgttgcatgcagtgagctaaaggaagctttgcttactttcacagattacaggtttattttataatcatgccatgaacacaagtcagagtaatctgattctttgctgcagtggcattagagcactgatagcacactctcctttttcagggagaatgttgtgtgtctggttgactggataaactcttcagtcttataggatttgaaagaacataaaaggcaggcatttatttactataataaaacaatagactttgcaatgaattctgtaataactgccttttaatcctcacagtcccccacacacacacacgagaactttataccccccaaaaaaaagttaaacgtcacacttactttattttatatctctgaagttggtcttcaatcaagcaaaaaaataagggataaagtgaaaggaaatttgagaaaagatcctgcaagaagcaagctgagactagaatttcataaaatccatttctagccctgtcagctgcctgcctcattaccttagactttcatataatcttttaagtctttagttcaatctttctactcagttatttttcttcagtttcttgtaaccttcaaaaatgctaacaatagaaatcacaggccaacctgaagttaatccagtaccttgtaaccacagccttttaccacccttaactgagctgtgtgtgggtggcttgcatcccacggttggtactctgggcttagagagtccttgcatgctatgtgggtggcgttcatcctgtagtgttcctacgggtttagggagtccctttccagtacccaatcagatatacattgttctttatatgctgggctgaaagattccatacttttgtttctaggaattcaggaccattcaactaagataatacggtataatgcagggaccaacaatctttttctttttgggctatgctgtctgtgttgcagctatgcggctctgcctttgtggtggggaagtagccatagacaacatatatataagtgaatgcatgtggctgtgttccagtaaactgtatttacaaaagtgggtggcaggccacatttggccctcaggccgtactttgctgactcctggtatctggacaagattgctgggtttcgagctgaggtttcacatggggcttgagacccatataatcacagagtggtctcaaatgggtctcatacttttgtatgtatttgtaaagttcacggtaatagcacttgccatgccttccttagaaagttacatgggataatttaatttttaatttttgttaacattctatagacttaaaaaaa

SEQ ID NO: 9041 - DNA, 502 bp, Homo sapiens
tttttttttttttgtatttttagtagagacacagtttcaccatgttggccaggctggtctcaaactcctgacctcaggtgatctacccgcctcggcctctcaaagtgctgggattacaggcatgagccaccgcgcctggcccaggagtcacttctaattcctcacagctatcccagaatgtctttgaacacaggatttagtgacagaaccacaacaagccatatgagagccccacactgggcggtacactgcacctggaaatgtgcgtgtgaatgtgattctaatctgaaaccccagcaacagatcacctagcaaagggaacaaatgtgaaaggagcctttttgcctgcgtgtacagcttcaggaagaatgcagaggagaagaggaggatgcccccagggtctgtgatatttttatatcaactccggcagtcaatgaggtgatgggtattataggtattatagctggtttccctcccatctaagtgttcccatgtgaaaatg

SEQ ID NO: 9042 - DNA, 886 bp, Homo sapiens
aagcatagtacccaataggtagtttctcagtcctcaccctcttcccacccaccaccctcaagtaggtcccggtgtctgtttttcccttctttgtgttcatatgtgctccatgtttagctctcacttataagtgagaacatgcagttttgattttctgtttctgaatgaggttgcttaggatgatggcctctggctccatccatgttgctgcaaagaacgtgagttcattcttttttagtattccacggtgtatatgtaccacattttctttatccagtttaccattgatggacatttaggttgattccatgtctttgctattgtgaacagtgctgcaatgcacatatgtttgcatgtgtctttatgttagaatgatttatattcctttgggtatatactcagtaacgggactgctgggtcaaatggtaattctgttttaagttctttgagaaatcctcaaactgttttccataatggaagaactattttacattttcatcagcagtgtgtaagttttcccttttctccacaacctcaccagcatctgttattgactttttagtagtagccattctgactgatgtgaaatagtatctcactgtgattttgatttgcttttctttaatgatcagttgtgcttagcattttttcatatgcttcttggccacatgtatgtgtactttcaaaaagtatctgttcatgtcctttgcccacttcttaatggggttgattattgcttgtaaatttgtttcagttcctaatagatgctagatattagacctttgttgaatgcatagtttgaaaatatttttcccataatgtaggttgtctgtttactctgttgatagtttcttttgctatgcagaagctctttagtttaattagg

SEQ ID NO: 9043 - DNA, 6245 bp, Homo sapiens
cccagcagtccaattacaacacagtcagcactagcatgaatggatatggaagtggcgccatggccagtctaggggtccctggctcgcctggatttcttaatggctcctccgctaactctccctacggcagtaagtgtctgtttttgtcacacgtcatcacgcagattcatattcactaccgagtcgagtgtgtgcattgcttggatgttctgtgatgtgagctactggataaaaggaagggtggccctggaggctgggcgtccaaatggcgaccgtaaattgacccaaaacgggcccgatgtgatctcattggaaaccaaaacaaaatcagaacaaaatgggctgctcaattggaagggaaagtccagtgcaaaagagcttgcctgttatccagagcgtggccgagccagacgcatgtcatgttttgttttcgtgcccctgcccccccgtccgaggcgaggcctttggtgccctctcgccgtggcgctgtgccgcggccgcgcgtgctgaccgtgtttgctttgttgcagtagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggtgagggtggtgcggggccgtgggccagtgctgggtcctctccaggggtggggatgggagtgggggtgggggctcggcctttctcctggcacctctgtgactgctgcatgttctcccgtggcccaccttgatgcgtgccacctctgcctggtgttcacagcgaggacccctgtgcactgagccccagaaaggaccagattcctcctcttggtttttgtccagctcacccttccgacggcacctagtgtacttacggtggagcaccctgtgcccctaagggggtgggaccacgtaagagaaggcgggagtgtggtgaaggtagctgtggtcactgtcggtctgattcagccaatgggcctttgcccggggcctggcacttctcagcgcaggatgctgccctgcccatagctcctgggcttgcagcctgctatgcacaaagcagcgaaaatagccctggcatgggaatggcggggcaccatgctacctgtggagcccatctcaaaatctgctaccctcgttgtcccgaggctgggccttggttctccaccttatctgctgggccacacatccagcagggctgcactgtcttttggaaagaggtgtgcgtctagacccagggccaggtgtgtaccaacaccaggttgcagtcctgtctgtggacaggagctgattttcctacgtgatctctttcaaagaatcaggagggagaagggccggccccgagggcacagctgtccacagatgaggccacacggggtgggcaccctgtgcctgcccagcgcctggcccatctgagctgtgcaggctgcacgtggcctgtgatgtgtgtgacgggcagagccacatgggtgcccccaggcctcatgaacttgcgagtggccctttgtgaggtgctgaggcccgcaggcacttaaattaagtggccgtcatctggcctctttcagacaccacctttggtatatgctcctcccagtgactcaaatccagttactcctttagaaacatgaacccattcaaccagtatttactgagcacctactatgtaccaggctctctgctgggtgctgaggacgtagccgcggagaagacaaactggcccttttgtgaagtcggtggcatatttcactttgatgaactaatgctcaaaaaaggaactggaaaggtatcagtgatttgaaatcattgtcttcacaacatccgttagcgtatgaagggacgcccaggcccccgaagtgccgccgactggcctgcgtgccatcagcgggcaccacaccagggtcgttgcagaggcaggtggtgaggtgccgcggccctgcccgtgacacggggtcgggccggctgaaagacggcacctcctacgcggtgtgtacgcacagggcttccaaaccgtaaagttgtaacggtgagtcggagataaattaatattgttgaaattaatgaactgagaaattgaagctcacgtcactacatgaacaaatgtattaatatgttatacataaattaatgagaacgatcattctgacaaaaattaaacaacaccagcggtaaaagattttaaattacattcgtaccaggagttcatgtgaaagcgtcagccccacttggcgttttcgtgcaaagttttctcttctttcctgagaagagaaaaaaggtcccgaggcggtgccatgactcacgtctctccgtggcccttgcctggaggttccagggcaggtgggctgtgagtggctttgattctggagagcccctgactcaccattacgatacagagagatgaccgcacggtcagagcccagacctggaagcagagggggaaactgaggccagtctggttctcacatagggagcgagagcagggcctgtgagccggccttgactggcgtcacgggagtgaccaggctgggtcacctctctcgacagagggggctccgggcctccgttggctttgcacctgttggcagtgcaccggtcagtgtggggaagctgcagcctctgcacacagcagtgccaggagcccttcccttttccaaaagaagcctttaaagaagcctttgaggagggctgcaggaggggcaggactgggggttgttgtccccacgtgtgcccccacctcaggaagcagattccccagcacgccctaaccacgcccgaggctggtggacggaactgtgcaagaccagcctcccagttgaataggggggaagggcagccccgcccgcgtcagcgttggcgggagggcgcgtgggggagcctgcagtaactgctctgtccttctgtcttgcagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttcacttttggtaattttctctgtttttgattattaaaatgactaaacactaacataaaagttacatcaggggtttcatttgcacagaccgggttctgaagctgcaacttggccaagataaaaatgttccacagaggaactttccacaaagttatccagcctccgtcctctaacctgcatagaaagagaggttcagcaaattgtcacttacgtggtcctgacccccagaggtgccatctgtattcatgctgcactctggctgatgtttctgtgtcacagatgttctgtgggccacagcagcactggggtgacacaatcactgttccagcacttgtctttgagaactcaaacaatcccaaggctcactgaggggcttcataacccactccctccagaccttctgccccagcccctctgcttctgaatagcgcactgggcaggtagagaacaacggctccggtgaccccagacacatgcttcttttggttccatggttgggttccactgggcaagaaccaggcttagaagagtgacacagcagcaaaggctctggatggg

SEQ ID NO: 9044 - DNA, 4798 bp, Homo sapiens
ccgagggcacagctgtccacagatgaggccacacggggtgggcaccctgtgcctgcccagcgcctggcccatctgagctgtgcaggctgcacgtggcctgtgatgtgtgtgacgggcagagccacatgggtgcccccaggcctcatgaacttgcgagtggccctttgtgaggtgctgaggcccgcaggcacttaaattaagtggccgtcatctggcctctttcagacaccacctttggtatatgctcctcccagtgactcaaatccagttactcctttagaaacatgaacccattcaaccagtatttactgagcacctactatgtaccaggctctctgctgggtgctgaggacgtagccgcggagaagacaaactggcccttttgtgaagtcggtggcatatttcactttgatgaactaatgctcaaaaaaggaactggaaaggtatcagtgatttgaaatcattgtcttcacaacatccgttagcgtatgaagggacgcccaggcccccgaagtgccgccgactggcctgcgtgccatcagcgggcaccacaccagggtcgttgcagaggcaggtggtgaggtgccgcggccctgcccgtgacacggggtcgggccggctgaaagacggcacctcctacgcggtgtgtacgcacagggcttccaaaccgtaaagttgtaacggtgagtcggagataaattaatattgttgaaattaatgaactgagaaattgaagctcacgtcactacatgaacaaatgtattaatatgttatacataaattaatgagaacgatcattctgacaaaaattaaacaacaccagcggtaaaagattttaaattacattcgtaccaggagttcatgtgaaagcgtcagccccacttggcgttttcgtgcaaagttttctcttctttcctgagaagagaaaaaaggtcccgaggcggtgccatgactcacgtctctccgtggcccttgcctggaggttccagggcaggtgggctgtgagtggctttgattctggagagcccctgactcaccattacgatacagagagatgaccgcacggtcagagcccagacctggaagcagagggggaaactgaggccagtctggttctcacatagggagcgagagcagggcctgtgagccggccttgactggcgtcacgggagtgaccaggctgggtcacctctctcgacagagggggctccgggcctccgttggctttgcacctgttggcagtgcaccggtcagtgtggggaagctgcagcctctgcacacagcagtgccaggagcccttcccttttccaaaagaagcctttaaagaagcctttgaggagggctgcaggaggggcaggactgggggttgttgtccccacgtgtgcccccacctcaggaagcagattccccagcacgccctaaccacgcccgaggctggtggacggaactgtgcaagaccagcctcccagttgaataggggggaagggcagccccgcccgcgtcagcgttggcgggagggcgcgtgggggagcctgcagtaactgctctgtccttctgtcttgcagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcccaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttcacttttggtaattttctctgtttttgattattaaaatgactaaacactaacataaaagttacatcaggggtttcatttgcacagaccgggttctgaagctgcaacttggccaagataaaaatgttccacagaggaactttccacaaagttatccagcctccgtcctctaacctgcatagaaagagaggttcagcaaattgtcacttacgtggtcctgacccccagaggtgccatctgtattcatgctgcactctggctgatgtttctgtgtcacagatgttctgtgggccacagcagcactggggtgacacaatcactgttccagcacttgtctttgagaactcaaacaatcccaaggctcactgaggggcttcataacccactccctccagaccttctgccccagcccctctgcttctgaatagcgcactgggcaggtagagaacaacggctccggtgaccccagacacatgcttcttttggttccatggttgggttccactgggcaagaaccaggcttagaagagtgacacagcagcaaaggctctggatggg

SEQ ID NO: 9045 - DNA, 453 bp, Homo sapiens
cgcctgccttgacctcccaaaatgctgggattacaggagtgagccaccgtgcccagccagatattgcacactttcaaaagcgtcagtaaatgattttctaggggaagctctttgcccattaagaaatagatttggtcatggtctgggcaagggacagtgggatgccaccatggtgggcccccgagagtgcggccagctgggccgggcctggggtgacaggccggctcccacttgctcctgctgcaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaaggtatgccagcatgctgggaggacccctgc

SEQ ID NO: 9046 - DNA, 467 bp, Homo sapiens
gtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggtgagggtggtgcggggccgtgggccagtgctgggtcctctccaggggtggggatgggagtgggggtgggggctcggcctttctcctggcacctctgtgactgctgcatgttctcccgtggcccaccttgatgcgtgccacctctgcctggtgttcacagcgaggacccctgtgcactgagccccagaaaggaccagattcctcctcttggtttttgtccagctcacccttccgacggcacctagtgtacttacggtggagcaccctgtgccccta

SEQ ID NO: 9047 - DNA, 4971 bp, Homo sapiens
aatcagtgggattcctttggatgatattgaatttgctaaggtaaagccctgagaatgttgcatctgtgtattgtgcatgataaacacagctagtggcatgatttattcattcattctttttctttttagggtagaggaacatttccctgtgatatttctgtccttgatattcatcaagatttagactggaatcctaaagtttctaccctgaatgtctggcctctttatatctgtgatgatggtgcggtcatattttataggtaacattcacaatgtttttgttgctgttagtaatacatttttggcgtgcatacatatcttattttccataaatatctttactgtttttatgatatggagcggcactaaccggtagaaatacagtgacagccaaacatgattataatttgaagttttctagtagccacattaaaaacaataaaaagaaacaggtgaaattaattttaaaaatattgtaaacccaatatatccaaaatatgatcattacatgtcatcagtataaaaaatcatttgtattttgcatttttttattgtactgagtcttagaaatattgtatgtctgttatatttccagcacatctcaatttgaaccaggcatatttcacaagctcaatagccacatgtggctaatggctgttgtattggacagcacagatgtagaggaaaaagaatagtcattggagcctcacaaatctgggttcaaaactagctttctgatttacctagctcctcatctataaaattgcaacaatgatgtctaccttgcaggattttatgagaattagagctgttgcatgtaaaataactggcacagtgcctattatagatgttcaataatgatagctgttactactgctaataacatggaagttattctccgccacttttagaagtaagcaatatgttcctgtgattaacaccttagaaatctgggacatctcagtatataaaataatattacttcaccagtaacagatttcattatcttgctgaggagcatcatagcattcaagcatacattaatagaggtggagggctctactggactaatatgtgattaatattttatatgtagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtcaaaatcttataaggccatatgtcctgaaaggcaaaactctgtgtatgtgcgatttaccagggagatagtaggacagtttttatgagggtttcaaaggagttcatggcccaaatgaagcttgtggccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtggg

SEQ ID NO: 9048 - DNA, 103 bp, Homo sapiens
tgtaacttggaaaaactgaaaacagtctcagtgtccatcagtaggagataaaatgtatattgttcggttattgaagagaatgtggtcactttgtatcctattc

SEQ ID NO: 9049 - DNA, 357 bp, Homo sapiens
cccctgaacctccatagtgcctccaagatgtgctgtccctgccaactcctgcaccagcttgactggtggtggaagaggccaggaagagcggggggaagacatgtgctaaccacttcttagcaatgaggctggtaaggttactgtccccttgtgcctggtcactagtaacttttttgtagacatgaaggtagatgccctgcaggtcctatcagcaaaggacccaactcctaacagcattggtgctccctcatgaaatttgacagtgtcttgccagcctcctgctggcagacacttctctgcagtgaataccactatcccatgctgcactagtccctaccaagtcttcaaccctcaatt

SEQ ID NO: 9050 - DNA, 1706 bp, Homo sapiens
ctagaatttactatttgttagttacatacaaaaattataatttatatacataaagttatactatgctgtcatttttaatatccgtacaacattgcatagtaccataatttagtctattgatgtacattaggttatttctaatattttgctatttatgtgcacattgcagtgaacactccctttacatatgtccttgtagtgttgtctcctaagatatattccttttatatcttacatggtgacaacattaaatatctgaactctgtgacatcttggggacatacatttacctctgataatttgctatttgtatgacccttgaattgagtaaatgcaccctaggcatggtagaccagagaactaaccagaaaagtggcactgtgtttagtcatcctagattctttaagatttttaaaggtaacttaagtagtagtttttgtctagtccatacatgcatgtggtgtaaaattcaaaagatatagaaaggtaaagtaaatctttctcccactctgaaacctcttctacccagtttctgctcctgggaaactactatgagtttattcatccttctgcacatattttatacatatatgtatactttctgcacatatatgtgcatatatatgtatatattttaagttttttgtaaatgatagcatactatgctgttctacagttcactttttctcacttaactataataatatctaacacttacgtagtgctttgttctaggccctgttctaacaagtgtttttgtattgattactaatcttcatcacaaacgtgagaagtaggtaaatattattcccttaccacagaggaagaaactgaggcacagaaactttaaatgacatgctagtaggttgtcagctggaaggtgaactccagcatccagcagtttggctacagagtcttttatattagcccatttgctatactaactcaattgttgcctcattctttttattaactacataatattcccttgaaaaaacttcagtttatctaactaggtcctagttggtggacatttaggtgtttccatatactgctgttatagatgatgctagtgtgaatatcctggtgcttataaatgcctgtgtcattttgaatatgtaaatctctttcattttcatccattcaaatttgggagttaggggagtcttgtgttcatatagttacattctattttgagatctaatatgagacttttttttcaatgaatgtatttagctaatttatatttattatatcattatggttatagcctcatcttttatagctaatggactaagagataagtcaaggtatgttaacaattgaaatatacttaaagatgtaaagcagtacagtataaagatattagcattcctcagtctatttactctctcacgttttgttggttatataaaaacattatcaggaattgtaacaattacattatattctatagccatagccatagttttagaccaatagttaagtggattcaaatgctcaaagtttgttattttcgatagttttttaaaaatcttttagatggctgaactttatcatcaagtattttcttaaagtttatgaaaactattccttagggttttgcatatttaatgatgttttatgctgggggtaaattcttgagtactctagatattgcttcactgattttttttttttttttttgagtcggagtttcgctattg

SEQ ID NO: 9051 - DNA, 106 bp, Homo sapiens
ttaacagtctttattgggctcagaccaggagtccgtgggtcttgaggacctctgtgtatttgtcagttttcttctccatgttcctattggcctgtatccgtaggct

SEQ ID NO: 9052 - DNA, 1515 bp, Homo sapiens
aggtaaattaaaagcatgatcattttgttgataatcagcctttggagaattaaacagcctgcttactgccagtgctagttcagtaaatatgtttctcattttctatttggcaaaattagataacctaagcctaggaaaaataaaaaattagaaaaaaaaaagtagatttggggatatttaactcaaattgcccttactggtggaaactcgaggcagttacttagattatttccaaatggcttttttaaaatgtatttctatattgtatacaacagtctcagtcttcatctctcctgttcagctagccatacatcccttaaaattagatatttttaatgtttagtaaaccttcagtttgggtttatagacaacatttaaccttctcatgaaagggtcagaatactccagttgcaggcacaaacaggccatagtttagttgaaggagaaactgcgaactcaaaggagcactgcttctctgcaggaaagatcccgtcagtggacctgcggggcacagctgccaccagtgtcatgtagctattcagtgtcggaaaactagaaatcacaagtgaagagaaattgtaaattacctcaaattctatgcccagaagcaaccactatggaaatccttctagacattgtcccgtataaatatatttccctaaaaaaaattataccccatactctgccacttcaaaaaaatcaagactgtttttccatgtcaataaatatctatatcatttaatgaatacataatactcccttgtttgaatgtacaatattctgtattgttgcacatttgttgtttccaatttaacaattacagtactccaatgaagcaatcatcttaaaatacatgtataacgtattataatgttccatcctttaaggttagaaacgacgtcccatacctgtctcccgtcactctgagaacagtgcggtaacaggatcagcgattctcaaccatgggcaatttagccccctatggcacatttgacaacgtctggagacatttttggttgtcacaactagggggtaggggatgctactggcatctagtggtggaggataggaagctgctaaacatcacgcaacgcacgggaccgtcctccatgacaaaggacccgtgcaaaatgtcaatagtgccactgttgagaaacccggattaagatcatgttgtaactacatttcagtgggataagactttgaaagtttccaccgggcacagtggctcatgcctgtaatcccaacactttgggtgcccgaggcaggtggatcacttaggtcaggagttcgagaccagcctggctaacatggtgaaacctcatctcttactaaaaatacaaaaactagttgagcatggtggtgcgcacctgtaatcccagctactcgggaggctgaggcacgagaatggcttgaaccggtgaggtggaggttgcattgagtcaagattgcaccactgcactccatcctgggtgacagatctagactctgtctcaaaaaaaaacgaaaaagaaa

SEQ ID NO: 9053 - DNA, 1515 bp, Homo sapiens
aggtaaattaaaagcatgatcattttgttgataatcagcctttggagaattaaacagcctgcttactgccagtgctagttcagtaaatatgtttctcattttctatttggcaaaattagataacctaagcctaggaaaaataaaaaattagaaaaaaaaaagtagatttggggatatttaactcaaattgcccttactggtggaaactcgaggcagttacttagattatttccaaatggctttttttaaatgtatttctatattgtatacaacagtctcagtcttcatctctcctgttcagctatccatacatcccttaaaattagatatttttaatgtttagtaaaccttcagtttgggtttatagacaacatttaaccttctcatgaaagggtcagaatactccagttgcaggcacaaacaggccatagtttagttgaaggagaaactgcgaactcaaaggagcactgcttctctgcaggaaagatcccgtcagtggacctgcggggcacagctgccaccagtgtcatgtagctattcagtgtcggaaaactagaaatcacaagtgaagagaaattgtaaattacctcaaattctatgcccagaagcaaccactatggaaatccttctagacattgtcccgtataaatatatttccctaaaaaaaattataccccatactctgccacttcaaaaaaatcaagactgtttttccatgtcaataaatatctatatcatttaatgaatacataatactcccttgtttgaatgtacaatattctgtattgttgcacatttgttgtttccaatttaacaattacagtactccaatgaagcaatcatcttaaaatacatgtataacgtattataatgttccatcctttaaggttagaaacgacgtcccatacctgtctcccgtcactctgagaacagtgcggtaacaggatcagcgattctcaaccatgggcaatttagccccctatggcacatttgacaacgtctggagacatttttggttgtcacaactagggggtaggggatgctactggcatctagtggtggaggataggaagctgctaaacatcacgcaacgcatgggaccgtcctccatgacaaaggacccgtgcaaaatgtcaatagtgccactgttgagaaacccggattaagatcatgttgtaactacatttcagtgggataagactttgaaagtttccaccgggcacagtggctcatgcctgtaatcccaacactttgggtgcccgaggcaggtggatcacttaggtcaggagttcgagaccagcctggctaacatggtgaaacctcatctcttactaaaaatacaaaaactagttgagcatggtggtgcgcacctgtaatcccagctactcgggaggctgaggcacgagaatggcttgaaccggtgaggtggaggttgcattgagtcaagattgcaccactgcactccatcctgggtgacagatctagactctgtctcaaaaaaaaacgaaaaagaaa

SEQ ID NO: 9054 - DNA, 412 bp, Homo sapiens
ctgagtcacatatattgagaggtatcctgtttgtacgttttctttgtaattataaagtctttaggcagtttatttctgtttattaaaataaatcagaagaaaatgtgtcatagtttactatatgttatatgaagagaaagttcttttggggatcatagttttatcatagtaataaaaaattatcagcagtaaaaaagatagtcttatctcacttttattatagtttatagcattacgacatactgttagcttttttagtaggtaaatactacatagattgctttaacatatgctttgcaattgttgaaatactgctcatttaagttccttcttagatgtgattcagaagtgtactttaatgtatttaagctatattttcctagttcagttatattgagcttttttttttttt

SEQ ID NO: 9055 - DNA, 417 bp, Homo sapiens
gaacaccaaggttgcggcagacaccagaagctggaagaggccaggaccgcctctcccctaacgccttcagagaaagcacagcctggccaccaccttcatcttcgatttctggcctccagaactgagagaatgaatgtctattgtttaagctgccagtatgtggcactttgttacagtagccctagcaagctaacattcagtatgtctgaagggtagtcaagaggaagctagaaattaagatgtcggcccatgtttggagtggatttaagccaaacagcgtactatgtgtgccctgctaaaaattataataacgagcaaattgttacagcctaagagtgaccccaggatttgtaactgacgttgagtgcccaagaactgcgtgataagtctattaagataaaattatttcaagtcctc

SEQ ID NO: 9056 - DNA, 554 bp, Homo sapiens
cttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgccttttta

SEQ ID NO: 9057 - DNA, 416 bp, Homo sapiens
gaacaccaaggttgcggcagacaccagaagctggaagaggccaggaccgcctctcccctaacgccttcagagaaagcacagcctggccaccaccttcatcttcgatttctggcctccagaactgagagaatgaatgtctattgtttaagctgccagtatgtggcactttgttacagtagccctagcaagctaacattcagtatgtctgaagggtagtcaagaggaagctagaaattaagatgtcggcccatgtttggagtggatttaagccaaacagcgtactatgtgtgccctgctaaaaattataataacgagaaattgttacagcctaagagtgaccccaggatttgtaactgacgttgagtgcccaagaactgcgtgataagtctattaagataaaattatttcaagtcctc

SEQ ID NO: 9058 - DNA, 20594 bp, Homo sapiens
caacagtcagttacctctgattgtaaaaggtcgctcctcctgagtcttagtgtttactagaatttgcttcaatgttttatttttgtgttaccagttttaggttgactgtataatgaaattctgtattttgaatcacatttccctgctgatatcagcccagcttataacaagtaatgcttgccttaaacatattttttctttctctcacttctgccatcaattcaacaataggattgcagatacagtttactttggggctgaattaagcagtagcagaggggtgtttgtaaactaactgatgttatcaataggcagggacacagcatggcttaggatcatggtcttccagcttgatgacctgctttgcaatctgtttgcttcatccacatcaatgaggagccagaccttctggtccttcatttactcatagactctcttaagagctttgtacattcaattctgaacttattggtgccataaaatattattactgtgcaaaagaataaaagtgctagtgtgttcttattagtagccatgaatttcatttctcttttccctcttcccacctgagattcatctttgaggggaagccagataccttgggcttcttattttcccatcctgcccttattcttggaaggtcctcaggtttgttgacatggtttttgttctctgggacttttctagtgtgttgtttgcatgtcagccagctcaacttaatgcatgtcagctcagtgccacttgtgctccatgtgacttcagttagcaccagtgtaaatcttgtggctgttaatagaggtggagtcccagctctgacggcagtagtgggagaagaagaggaaattgtcagggcccaaacatttcatatctcatttaaatggatctgaccacttcatagaaaagaaaatttgaatcattgtgctcaaaggtttcccctttgagatacatattttgacctttataaactatagagcatttgtgttttcatggatggttatgtttagttttataaggaccaactctgctatacttcggattttcaggttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagtaagtactttgatactgcttattgtatagtgagttccatgtgtaaagatttgctatttatgttttaagtttttctgcaagtcttgtttgaggtagtttttacttaattttgtatgaaaccattgaatccaaagttaaaaattatttaaaataattatatgatcccttaaggcccctttcacttctaaaattcagtgcttttatggtattatactatatttaacatagcctaggaaataatttccaactagccaactttcttgttcctaagtatcagaagtttcagtgggccttgatgcccttaaatgtttttgatgggcacctgtcttattctgcaaagttggctttgagagcagattatacatattgtctctcttaggttacaagagaagcatgtcaaagatgagcagattgaacattggaagaagatagtgaaaactcaggaagaattgaaagaacttcttaataaggtgaaattctgtattttcttcatagctgaagaagctttaataggagaaaaagtctttagaaattttaaaagcatttccgagattttttcctccatggaagagaaagtctgcacagctgggactcattcttaagaaaataatgactaacgaaagagactgttttatctgtcagtctttcagtgtggcattattgataaatggttgccagaggaaatagatctttcctctttgtctggttccctttggctcaggggtgtccagtcttttggcctccctcagtcacattggaagaagaagaattgtcttgggcaacacataaaatacactaacactaatgatagctaatgagcttaaaaaaaatggaaaagaaaattcagtgttttgagaaaatttatgaatttgtgttgggccgcattcaaaactgtcctgggccacgagttggacaagcgtggtttagctattctaaagctatcccagtgccctcagctgaattctaggactagcaggagaattagctgtactggagccaagttttcattggtgaagaccaacaaatcagcagccagttcattggcataattatttctcttgagttgctgccacccccacctctgttccccagggctgaaccgttagggctcttctctgccaccgccttccagagccccaggctccagcgcattaaagtccaaccatttgcttctcctcaccctgccagctgcaaaggtcgcatcagcttagggagaaaatagcccctggagggggcctttatagtgcatactctgggtgtgcctgtgactggactcttgcctcactctcactgtgcctcattcttcatcctgtctaatgaagagatctccagctcacagtcttcatggattgtggtaaggatgaaatgagaagagtgatttaagaactgccaagtggccaggatacctgtagggtggcccagtctcaggctttgtcactcttgtcctgtgtggtatcatcagaaacctgaaaaaagctaacattaacaatggttccttaagattctttggccaggcacagtggcttatgcctataatcccaacactttgagaggctgaggcaggtggatcatttgaggtcaagagctcgagatcagcctggccaaatggtgaaaccccttctctactaaaatacaaaaaatttgctgggcatggtagcacacacctgtaatcccagttactcaggaggctgaggcatgagaatcatttgaacctgggaggcagaggttgcagtgagctgagattgtgccattgcactctagcctgggtgacagaacaagactgtgtctcttagaaaaaaaaaaaaaattctttgaccttttacatatttaaaaaacacattataggaccaggcatggtggctcacgcctgtaatcccagcactttgggaggccgaggagggcagatcacgaggtcaagagatcgagaccattctggctaacatggtgaaaccccatctctactaaaaatacaaaaaattagttgggcatggtggcgggtgcctgtagtcccagctactcaggaagctgaggcaggagaatggcgtgaacccaggaggcagagcttgcagtgagccgagatggtgccactgcactccagcctgggcgacagagtgagactctgtctcaaaaaaaaaaaacaaacacacacattatgacaatttgtttccgaaaataagtttaagttacattagcaacagtttcctttttgtggagattaaatttatttcaatactgggttttttctttgtttgtttaaattaatgggacactcctcatccttctcattcgttttagaaggcagcactgatcttacttatcagatagagttgtggtacctttatgtcaagccctataagatttctttcctatttcccaaatggaatgatgtaggttagaacaagtacttaagaattctcaggaccttgcattgtagccctgttttgttgggatagcagttttgaggagccaaaaaagggtacatgtgatgtagacataaactacattgctatctggaatggtaaatttgtatttttccttcttagatggtaaatttgaaagagaaaattaaagaactccatcagcaatacaaagaagcatctgaagtaaagccacccagagatattactgccgagttcttagtgaaaagcaaacacagggatctgaccgccctatgcaaggtgtggtatacatacatgcctaactggttttacttggaatcctaagaaatagcacagatctggggaattttggaaaagagagccactagccaatcacaagtgccttcagtgcaatgaagacgatttggtacataaggagccatggggatttaatgggttagttcggtttaagacctgcttgtcctgcagaattcttatcctgtcttaataatctcatcattttatcttaaatctcaatttagccctaacagtttagagtaagagtattaaacatggacttcagagtcatttggggtcaaactgtctgattcaaatccctaacttggaatctcgagccatgtgaccttggactccttaattgcctcatctgtaacatggtcttaacacctaccttgtagggtaattgtgaagcttaaataaaattatgtataaagtgcttacccagtgccagggacatggcatgcttatgaaatggtgcttgctatgatttttcatccccactttgcagcacactagtatgtttcttccattattttctcctgtgtgctccttgcctccccctaatattccaggcccccaactgtaacttgtctccaaaaacaaaaatctctcagctctatctaaccccagcctaaaattgagccacacttcctgtacatgatctgaagaggaaatatgatccagaccttatactttgtggtacaaagaaactaggtggatatctgacccttcagggtaactcaggttcacttaatttttatcaggaatatgatgaattagctgaaacacaaggaaagctagaagaaaaacttcaggagttggaagcgaatcccccaaggtaaggaaaacaaacacaaaagttcagagggagagcttttactgttctttcagcttgatttggaaggaaaattctaaatcataatgagcttttatttatgttcagtgagtggtttaaattgttaaataaatgaatgtgtgactacttttgaggtttctaaatcccctgctcctgtattttaatgtgtcctagatacctaaacagattgtttctaaagagagagcctttctccgtaagatctgatatttggataaagatgtaatagatggaaattatctttcttgagagggtagaagttgctgttgctttacacttccataattttggaaactagcggggtattatactttatttccactgggtttttgacagtgaatgctggtgaaatgttttcacttgcatccagcctccacataaatctgttctgttctgtattcaagaatgctacccaccctttctttttttgagatgggatctcgctcttgttgcccaggctggagtgcaatgatgtgatctcagctcactgcaacatccacctcctgggttcaagcaattctcttgcctcagcctcctgagtagctgggattacaggtgcccaccaccatgcccagctaatttttgtatttttagatggggtttcacctgttggccaggctgatctcgaactcctgacctcaggtgatccacctgcctcgacctcccaaagtgctgggattacaggcatgagccacagcatccagcctgcccatcctttctatagagtctatgctgtgtgtaaaatataagacattttttacaactagtaagcttttatgatataaggtgatttcatatgaagcattcttttttttttttccttcagacaaatgaggcctacatgtaatttgctttacgtagtgagcttggcactgctctagacatcagagataaagaggttaataagacagataagatgctactttttgatttgtaatttcttcatataaggcacagccctggcttaggttctgacacagttactgagatcacctacatcacactgagagaactagtgatatcttttaataatcctgtagtcctttgttcttttgcagtgatgtatatctctcatcaagagacagacaaatacttgattggcattttgcaaatcttgaatttgctaatgccacacctctctcaactctctcccttaagcactgggatcaggtaagtttcccttattgtttattttattgcacatgcctttgagagggattgtaagagaaatagttaattttgtatgtgtgtttttaaacagctttagtaagagacatcatttacatacagtgaaattcacctattttaagtgaacagtttattgatttgccagacttcagtcataagcccccacacaatcagaatatagaacatgcccatcatcctgaaatgttttctcctgcctctttgtagttaatcccccatgctctggctcctggccctggacaaccactgatttgcgttatcactgtaattttgtttattctacagtttcatataaagtgaatcatacagtacatagctttttgtgtgtgatatatttcacttagtatagtttttgagatgtgcatgaagtttttgagattcatcttttttgcctgtatcagtagtttgttccttttaattatttaatagaattccattgtgtggatataccactggtgccttaatgggcatttgggttgtttcccttttttgactgctaatgaacgaagctgcttaagaatgttcatgtctttctcttgagtaaatatttatgaatggaattgctgggtactatggaaagtggatttttaactttataaatcaacttccaaactattttccaaattgccttcccatcagcaatgtatgaaaattccattttctccaaatcctcaccaatcttggtaatgccagtttttaaaatgtcagccattctaataggtatagtagtatttgcatttccctgatgactagtgatgtagagcaactcttcctgagcttatgagccattcatatgtcatctttgagtaaatgtctgctcagatcttttgcctattaaaaaagtctgattgtctgcttgttgatgagtttgaagtttattatgttctttaaattctaggcagaagtcctttgtcagatttatgttttacaaatatttatttccttgtcatctgtggcttgtctttaattttctaaatctgtctcaaagagtaaaagtttttactttaatttttttcttttgagacaaggtcttgctttgttgcccaggctggagtggtgtgatcatggctcccttgcagcctttacctcctgggctcaagtgatcttcctgccttggactcccattcctatttataaaatttttcttttaaaccatgttctttttctatcttgaaaagaatctttgtcttacctgtggtcacaaagatgttatcctgtgttctcctgcagaaattgtatgggtttagctcttatgtttaggtctatactccattttgtgttaatttttatgtttaaggaaaggtaagtgaagggttcatgtttttccatatagttatgtaattattattccagcactatccttttcttcatttgtcttggcacctttgttgaaaattaattggcatgtaagcatgagtatttagggttgtcttttctgttaatttatctgtctatccatatgccactatcatactgtcttgtaagttctccaactttgttcatttttgaaattgttttggctattttaaggtacgtatttccataacagttttagaatcaacttgtcaatttctacaaaaatcaccttctgggattttgattaggagtgcattaaatttctaggtcaatttagggtgaattgccatcttaacaatattgaatattcttatccttaaatacagtatacttctccaaaaatagttttctttcgtttatgtcagtgatgttttatagttctcagtgagcagggctataccatcttttcttaaatttcagtgtgatttactcttcaagtgagaaatcacaaggcttcttggaccaatctctaaatctgagactttggccagaattaagactgtataggctgggtacggtggctcacgcctttttaaacccagcactttgggaggccagagcaggaggatcaattgagtcaggagttcaagaccagcctggccctgtctctactaaaaatacaaaaattagccgggcatggtggcgggcacctgtaatcccagctacttgggaggctgaggcacgagaattgcctgaacccaggaggcagaggctgcagtgagcggagatcgcgccattgcactccagcctgggcaacagagcaagactccatctcaaaaaaaaaaaaaatgtatagaagtaaattattaaatttttatttatatattttagtttacattatacattttcctaataaaaattattttgacaggctgggcatggtggctcatgcctgtaatcccagcactttgggaggccaaggcaggcggatcacctcaggtcaggagttcgagaccagcctggccaacatggtgaaaccccatctctactaaaaatacaaaattagcctggcgtggtggcgcatgcctgtagtctcagctgcttgggagactgaggcaagagaatcgcttgaacccaggaggcggaggttgcagtgagccgagatcacgccactgcactgcagcctgggcaacaagagcaaaactccatctcaaaaaaaaaattattttgacttcttaatctttagattataatctgatagttttagtatttgaagagttggacttgttagagataaagtcttgcagaactaccagttcctttgtggtttttcatgtaaatactaacttaggcccttctagtcattgatttatcatttgatgtttcaatatgtgtctatttgtaatagtattaaattttaaatgagtgatttcagctgaagtagagtgttgctgccagcccagtattttgatctaatttccccaagaatttcatgaaattagaaatccttaccagcttacaaaaaaaatgttacatagaaaaattttcagtaaattcaaagaagtaagatcattttggggatctttaaattcctggtcaattcctgactttttttttactgtatggactgtcttgggccactctttatggtcctagattaccttcatctagtttgactgacttagttttggaaatcttcctcaacttcaaacctgtaaatttaaagaataaaaactgattttgctctcaggtaaaagaaaatgtaatcaggactgtgaccctgatatccttcaagtctgtaatgtattcaaaagccagataaataaacttgaatgatgtttaatcatctgaatttcctgaatcatcattccccctaccacctccctaccctaaccaccatagaagatccggacttagtggtattggactggaatgataaaaactatccagggaaggccgagcgtggtggctcatgcctgtaataccagcactttaggaggctgaggtgggtgggtcaggagtttgagaccagcctagccaacgtggtgaaaccccgtctctactaaaaatacaaaaactagcggggtgtggtggtacatgcctgtaatcccagcagttacttgggaggctgaggcaagagaatcacttgaacccaggagtccgaggttgcaatgagccgagagcacgccactgcactccagcctggatgacaaagcaagactctgtatcaaaaaaaaaaaaaaatccagggacaaaagaaacttccctaatctcactacccgaagatttagggacattttttggtgttttctctttttccttcagtttcctttggtaactgtagctaaatactgagtgatttgttctttagtttgccttaaaatattgactgtttccacaagcttgtgttttcattgttgttgtacagaactaggtgcaaatgacacagattaataaaaggttggaaatatgttcttttctctcctctttaggatgatgactttgagttcactggcagccacctgacagtaaggaatggctactcgtgtgtgcctgtggctttagcagaaggcctagacattaaactgaatacagcagtgcgacaggttcgctacacggcttcaggtatgtcactgctttacaaaaggtaagagagaactctcctgaaacaggactgatcttttgttaggtgcgacctatcaggtacatttcctgatagagtgtttatgacaccataggtaaaaattggcatttatagacagttgagcctatagagtctttggtggttctaaccctatcattttataaactgggaaatcgaagcaagttttagagtttccaatttgtgcatgagctagttggatattactggtcgagcatccctaatctgaaaatctgaaatctctaatgccccagtgagcatttcctttgagcaccatgtcagtgctcaaaaagttttccattttggtgacccagtgagtttggatctagttttgttaagtatattcataaataccaggattttggcccctgggctccactaggacccaccccttatatttcaccatccgcattttggtctttggattcattttggctttttctatgcatttgggctaattcgcttacgtttggttcctagttctggagcagtcctgctaataagttgacttcttcagagatagagtttccctgtgcttgctatggggataggctcaatgctcattattattgctggtttcaggctacatttgatgtaaagtgcagacaactgttggattttgaactcctcaagataactagtcatctccctctctgagaacccatgtatgactatgtaggcatgagaaatggagacatagccatcaatcttaccctgcgctgcccctttccttggagttactgagatcaccacagatgttttggttttttactaacaatcagtgaaacagttttccatttaattttcccatcagaggcagcttgtagttgacagtgctgagaagatctgcagccttgagccttttgcaggcagacggagaacagtgagaatagatgttgtgccattttctcgagttctgcagccatagaaaatgagcatgtactgagctttcatatttattttgagatatataatttcaaaatatatatagtatataaacagacattcattaaaaaacaaacgaggaaaacgatgttaacataatttcagtaccctctctgaggtcagctttgaactcattcatactctgacaagctgagaatcactgtgcattctcaagcatagcacgctccacagttttaggctgcatcccccagatctgcatcacagccttcttgtagcattcttctgttggtcgatagtgagcagctaaccacagtcagaagacattggttctattgggatgagcactttattctttatttttggtctaaatgtacttaacttgagtaagtggtataaggtcctttcattagtctagatcaccagtgtatcaggagggtagtgtggggatgacagttgaggattctgaagttgactacaagggtttgaatcctggcacttattacgtgtgtagccttagatgagttatttcacctctacctcagttttcttatgtgaaacatgaaggtaatgaaaatagaaaaatgagaattgagaaatggatgtccatctgttgtacactaaatgttcagtgtccttatcagtgccatattcatcaccactagtcttttcccacccaacctctgcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcagattagaagagactttaaggaagtctgttgaagccagtattatctggcccctgtcactggctcatgtgcttctttcttatggtaggtggtgttgtgttttgatcgggtgttctgggatccaagtgtcaatttgttcgggcatgttggcagtacgactgccagcaggggtgagctcttcctcttctggaacctctataaaggtaaatgccttctaattttaatcttttccatatccttacaggaatatagaatttgaaatattttgggttttctcaatatatatgccttaatttctctctttattaactcaacaaacaattcctgaaataccttctaggtactggggtataaaaatacctgccttcaaggagctcccaacttagtggggatacagtaagcggggaagcaggcttagaacagggcagtaggtggcctgatgggctgaacgcccaggttactggaggtccactcagcctggagggataggcccagggaggcttcctaccaggggaagcttgcgttctcattctcagactgacttgcccctgattctttgattacttctcttactatgtgtttatgaaattcctacctcctgttcagttattttcttttgtaattggacttaactgtatgtagacttgtaatatttgtaccccacctcattccaagaaaaggctgtaaaaataagacattggccttgtcagtgcagacacatcagctaaccgttggcttgctccccatccccagttctttccattactcctcactgcccagtggtgaatggtctttcacaccccagagcctctaacttcacagagggggaacttggctccctgagcacattgctttctgagagcagcagcgtgtcttttcccttccccatccaggctgtcaagtcctgtcagtgctagccttacaatctcttgcaaacctatttacttttttctattgcctacctcccagtccaagccattcttacctgttgcctggacggttaccaatagctactactgctattcctgcttcttttagtgactttctactgctgaaagaaaatgttcaaactccttatcttggcccatgctaaggttcttcattatctagctcatctctacttccttgtccatccccagattccaggcacattcggctgttctcacatcctggaaggcaccatgctgctttctgcctcagagcctctgcgtgtactgtggtctaggcctgggggtgctgcttctcccaccccctcgacccccttccttcccaacctgtcttactcagcattcaggtcttgacataaatttcaaagtatttcaaagacgacttccaggacacatctccactgccccaaatgtaaattaaataccccatattcttttccgtgtagcctacgtttttcttcatagcttttaagttaataattgtctgtgtaattttgcatctgttgctctattggagtaatagtttatatcatattttttatcccccttttctagtactgtgcctaccacctaagtctgttgcataattactcaccggatgggtgactgaagacagtcctgggcttggaggggcctgggatggctaaaagggatgtagtcattgtcatggagctatccaaggtagtcaaggttaagaattctgtgccaaagtaaagcgatgcttaataattcccttttattagcaagatctgaaattatatcttcagaactgctgtattttgccaggttagaagcagtgaggtgcctgagaatcttacttcactctagtctgccagctcctactggctggtgtctggcgacaaagagttctgtatgctgtttcagaaacataatctgtctcttcgcatttgaatggtactgcgtgtgtcttgtcatcagatttcagagcaccaggaataaggtggggcctgataaggaagtttttgaggaaagtctgtaggaaaaccctagaattatcctttctgtttccccagctccaatactgttggcactagtggcaggagaagctgctggtatcatggaaaacataagtgacgatgtgattgttggccgatgcctggccattctcaaagggatttttggtagcagtgcagtacctcaggtaagtaggtaggtggggcaaggagggatctagggttcagactcaaccagggtttaatgtatttgcagcatgttcttggtcaggacagtttaagctagaattgaggtctgtgcttttacatgaataattaatgtttggagttcatggcctaagcgtggggttcagaaaaccccccaggacaagagctggggagtctgaaggctgctagctgcatttctcctccggctttagagtcacaccagatccctgacattttagacaaaatggccaaactccagtgagtatctccgggaagttttcagagaacctcttggtactttttcgtgttctttgaaatactttaaccctttaggattcctttgaagggaaggatattgtgaatttataaaagagaataaaggccaagccctgtgtagatctctggattcatagacaggaaggcaacatggaggggcatccttcctgtctgaagtccttttgtccatgtgtgttttaaagcaggcattcatcacttgatcactggctctcacatgttgcccctctttctcttcacttgcatctccacccaccactgcttttccacctttcaaggattgatttgtgcttggtgtctcgtaatgacttttgctcctggtttttcttttagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacaggtgagaagctggcaaactatctgggcttatttgggaagaggccaggatctcatgatgtccctgattttttttttttttttcagattttagtcattccatcttcggaccctttcagataaccaagagcagagttaaaaggatgggcagcatttctgatttctcataatttggttttgtaaatctaggcagtctacattcagaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagctgcgaggcttaagtgtccctgatcaccaaatgtcctgtgcttcagggtagcgaggctccctcccagaaggtagttatacatgagggaaggacgctttacaactgggtatctaaactgatgagaacacatgttaagcatcactttaggactgagcctaggtagagttttattgtctcatttctacttgtcaattctgggaaagtgcctactgataagggagactcttcgatagaatgatgaatagtaattgggggggtcagcctttaaaaaggtcaacagcaatttaagtacttagcaatttaagtacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggaagcttaaagtctaaaatgggtacacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagattgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttga

SEQ ID NO: 9059 - DNA, 20595 bp, Homo sapiens
caacagtcagttacctctgattgtaaaaggtcgctcctcctgagtcttagtgtttactagaatttgcttcaatgttttatttttgtgttaccagttttaggttgactgtataatgaaattctgtattttgaatcacatttccctgctgatatcagcccagcttataacaagtaatgcttgccttaaacatattttttctttctctcacttctgccatcaattcaacaataggattgcagatacagtttactttggggctgaattaagcagtagcagaggggtgtttgtaaactaactgatgttatcaataggcagggacacagcatggcttaggatcatggtcttccagcttgatgacctgctttgcaatctgtttgcttcatccacatcaatgaggagccagaccttctggtccttcatttactcatagactctcttaagagctttgtacattcaattctgaacttattggtgccataaaatattattactgtgcaaaagaataaaagtgctagtgtgttcttattagtagccatgaatttcatttctcttttccctcttcccacctgagattcatctttgaggggaagccagataccttgggcttcttattttcccatcctgcccttattcttggaaggtcctcaggtttgttgacatggtttttgttctctgggacttttctagtgtgttgtttgcatgtcagccagctcaacttaatgcatgtcagctcagtgccacttgtgctccatgtgacttcagttagcaccagtgtaaatcttgtggctgttaatagaggtggagtcccagctctgacggcagtagtgggagaagaagaggaaattgtcagggcccaaacatttcatatctcatttaaatggatctgaccacttcatagaaaagaaaatttgaatcattgtgctcaaaggtttcccctttgagatacatattttgacctttataaactatagagcatttgtgttttcatggatggttatgtttagttttataaggaccaactctgctatacttcggattttcaggttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagtaagtactttgatactgcttattgtatagtgagttccatgtgtaaagatttgctatttatgttttaagtttttctgcaagtcttgtttgaggtagtttttacttaattttgtatgaaaccattgaatccaaagttaaaaattatttaaaataattatatgatcccttaaggcccctttcacttctaaaattcagtgcttttatggtattatactatatttaacatagcctaggaaataatttccaactagccaactttcttgttcctaagtatcagaagtttcagtgggccttgatgcccttaaatgtttttgatgggcacctgtcttattctgcaaagttggctttgagagcagattatacatattgtctctcttaggttacaagagaagcatgtcaaagatgagcagattgaacattggaagaagatagtgaaaactcaggaagaattgaaagaacttcttaataaggtgaaattctgtattttcttcatagctgaagaagctttaataggagaaaaagtctttagaaattttaaaagcatttccgagattttttcctccatggaagagaaagtctgcacagctgggactcattcttaagaaaataatgactaacgaaagagactgttttatctgtcagtctttcagtgtggcattattgataaatggttgccagaggaaatagatctttcctctttgtctggttccctttggctcaggggtgtccagtcttttggcctccctcagtcacattggaagaagaagaattgtcttgggcaacacataaaatacactaacactaatgatagctaatgagcttaaaaaaaatggaaaagaaaattcagtgttttgagaaaatttatgaatttgtgttgggccgcattcaaaactgtcctgggccacgagttggacaagcgtggtttagctattctaaagctatcccagtgccctcagctgaattctaggactagcaggagaattagctgtactggagccaagttttcattggtgaagaccaacaaatcagcagccagttcattggcataattatttctcttgagttgctgccacccccacctctgttccccagggctgaaccgttagggctcttctctgccaccgccttccagagccccaggctccagcgcattaaagtccaaccatttgcttctcctcaccctgccagctgcaaaggtcgcatcagcttagggagaaaatagcccctggagggggcctttatagtgcatactctgggtgtgcctgtgactggactcttgcctcactctcactgtgcctcattcttcatcctgtctaatgaagagatctccagctcacagtcttcatggattgtggtaaggatgaaatgagaagagtgatttaagaactgccaagtggccaggatacctgtagggtggcccagtctcaggctttgtcactcttgtcctgtgtggtatcatcagaaacctgaaaaaagctaacattaacaatggttccttaagattctttggccaggcacagtggcttatgcctataatcccaacactttgagaggctgaggcaggtggatcatttgaggtcaagagctcgagatcagcctggccaaatggtgaaaccccttctctactaaaatacaaaaaatttgctgggcatggtagcacacacctgtaatcccagttactcaggaggctgaggcatgagaatcatttgaacctgggaggcagaggttgcagtgagctgagattgtgccattgcactctagcctgggtgacagaacaagactgtgtctcttagaaaaaaaaaaaaaattctttgaccttttacatatttaaaaaacacattataggaccaggcatggtggctcacgcctgtaatcccagcactttgggaggccgaggagggcagatcacgaggtcaagagatcgagaccattctggctaacatggtgaaaccccatctctactaaaaatacaaaaaattagttgggcatggtggcgggtgcctgtagtcccagctactcaggaagctgaggcaggagaatggcgtgaacccaggaggcagagcttgcagtgagccgagatggtgccactgcactccagcctgggcgacagagtgagactctgtctcaaaaaaaaaaaaacaaacacacacattatgacaatttgtttccgaaaataagtttaagttacattagcaacagtttcctttttgtggagattaaatttatttcaatactgggttttttctttgtttgtttaaattaatgggacactcctcatccttctcattcgttttagaaggcagcactgatcttacttatcagatagagttgtggtacctttatgtcaagccctataagatttctttcctatttcccaaatggaatgatgtaggttagaacaagtacttaagaattctcaggaccttgcattgtagccctgttttgttgggatagcagttttgaggagccaaaaaagggtacatgtgatgtagacataaactacattgctatctggaatggtaaatttgtatttttccttcttagatggtaaatttgaaagagaaaattaaagaactccatcagcaatacaaagaagcatctgaagtaaagccacccagagatattactgccgagttcttagtgaaaagcaaacacagggatctgaccgccctatgcaaggtgtggtatacatacatgcctaactggttttacttggaatcctaagaaatagcacagatctggggaattttggaaaagagagccactagccaatcacaagtgccttcagtgcaatgaagacgatttggtacataaggagccatggggatttaatgggttagttcggtttaagacctgcttgtcctgcagaattcttatcctgtcttaataatctcatcattttatcttaaatctcaatttagccctaacagtttagagtaagagtattaaacatggacttcagagtcatttggggtcaaactgtctgattcaaatccctaacttggaatctcgagccatgtgaccttggactccttaattgcctcatctgtaacatggtcttaacacctaccttgtagggtaattgtgaagcttaaataaaattatgtataaagtgcttacccagtgccagggacatggcatgcttatgaaatggtgcttgctatgatttttcatccccactttgcagcacactagtatgtttcttccattattttctcctgtgtgctccttgcctccccctaatattccaggcccccaactgtaacttgtctccaaaaacaaaaatctctcagctctatctaaccccagcctaaaattgagccacacttcctgtacatgatctgaagaggaaatatgatccagaccttatactttgtggtacaaagaaactaggtggatatctgacccttcagggtaactcaggttcacttaatttttatcaggaatatgatgaattagctgaaacacaaggaaagctagaagaaaaacttcaggagttggaagcgaatcccccaaggtaaggaaaacaaacacaaaagttcagagggagagcttttactgttctttcagcttgatttggaaggaaaattctaaatcataatgagcttttatttatgttcagtgagtggtttaaattgttaaataaatgaatgtgtgactacttttgaggtttctaaatcccctgctcctgtattttaatgtgtcctagatacctaaacagattgtttctaaagagagagcctttctccgtaagatctgatatttggataaagatgtaatagatggaaattatctttcttgagagggtagaagttgctgttgctttacacttccataattttggaaactagcggggtattatactttatttccactgggtttttgacagtgaatgctggtgaaatgttttcacttgcatccagcctccacataaatctgttctgttctgtattcaagaatgctacccaccctttctttttttgagatgggatctcgctcttgttgcccaggctggagtgcaatgatgtgatctcagctcactgcaacatccacctcctgggttcaagcaattctcttgcctcagcctcctgagtagctgggattacaggtgcccaccaccatgcccagctaatttttgtatttttagatggggtttcacctgttggccaggctgatctcgaactcctgacctcaggtgatccacctgcctcgacctcccaaagtgctgggattacaggcatgagccacagcatccagcctgcccatcctttctatagagtctatgctgtgtgtaaaatataagacattttttacaactagtaagcttttatgatataaggtgatttcatatgaagcattcttttttttttttccttcagacaaatgaggcctacatgtaatttgctttacgtagtgagcttggcactgctctagacatcagagataaagaggttaataagacagataagatgctactttttgatttgtaatttcttcatataaggcacagccctggcttaggttctgacacagttactgagatcacctacatcacactgagagaactagtgatatcttttaataatcctgtagtcctttgttcttttgcagtgatgtatatctctcatcaagagacagacaaatacttgattggcattttgcaaatcttgaatttgctaatgccacacctctctcaactctctcccttaagcactgggatcaggtaagtttcccttattgtttattttattgcacatgcctttgagagggattgtaagagaaatagttaattttgtatgtgtgtttttaaacagctttagtaagagacatcatttacatacagtgaaattcacctattttaagtgaacagtttattgatttgccagacttcagtcataagcccccacacaatcagaatatagaacatgcccatcatcctgaaatgttttctcctgcctctttgtagttaatcccccatgctctggctcctggccctggacaaccactgatttgcgttatcactgtaattttgtttattctacagtttcatataaagtgaatcatacagtacatagctttttgtgtgtgatatatttcacttagtatagtttttgagatgtgcatgaagtttttgagattcatcttttttgcctgtatcagtagtttgttccttttaattatttaatagaattccattgtgtggatataccactggtgccttaatgggcatttgggttgtttcccttttttgactgctaatgaacgaagctgcttaagaatgttcatgtctttctcttgagtaaatatttatgaatggaattgctgggtactatggaaagtggatttttaactttataaatcaacttccaaactattttccaaattgccttcccatcagcaatgtatgaaaattccattttctccaaatcctcaccaatcttggtaatgccagtttttaaaatgtcagccattctaataggtatagtagtatttgcatttccctgatgactagtgatgtagagcaactcttcctgagcttatgagccattcatatgtcatctttgagtaaatgtctgctcagatcttttgcctattaaaaaagtctgattgtctgcttgttgatgagtttgaagtttattatgttctttaaattctaggcagaagtcctttgtcagatttatgttttacaaatatttatttccttgtcatctgtggcttgtctttaattttctaaatctgtctcaaagagtaaaagtttttactttaatttttttcttttgagacaaggtcttgctttgttgcccaggctggagtggtgtgatcatggctcccttgcagcctttacctcctgggctcaagtgatcttcctgccttggactcccattcctatttataaaatttttcttttaaaccatgttctttttctatcttgaaaagaatctttgtcttacctgtggtcacaaagatgttatcctgtgttctcctgcagaaattgtatgggtttagctcttatgtttaggtctatactccattttgtgttaatttttatgtttaaggaaaggtaagtgaagggttcatgtttttccatatagttatgtaattattattccagcactatccttttcttcatttgtcttggcacctttgttgaaaattaattggcatgtaagcatgagtatttagggttgtcttttctgttaatttatctgtctatccatatgccactatcatactgtcttgtaagttctccaactttgttcatttttgaaattgttttggctattttaaggtacgtatttccataacagttttagaatcaacttgtcaatttctacaaaaatcaccttctgggattttgattaggagtgcattaaatttctaggtcaatttagggtgaattgccatcttaacaatattgaatattcttatccttaaatacagtatacttctccaaaaatagttttctttcgtttatgtcagtgatgttttatagttctcagtgagcagggctataccatcttttcttaaatttcagtgtgatttactcttcaagtgagaaatcacaaggcttcttggaccaatctctaaatctgagactttggccagaattaagactgtataggctgggtacggtggctcacgcctttttaaacccagcactttgggaggccagagcaggaggatcaattgagtcaggagttcaagaccagcctggccctgtctctactaaaaatacaaaaattagccgggcatggtggcgggcacctgtaatcccagctacttgggaggctgaggcacgagaattgcctgaacccaggaggcagaggctgcagtgagcggagatcgcgccattgcactccagcctgggcaacagagcaagactccatctcaaaaaaaaaaaaaatgtatagaagtaaattattaaatttttatttatatattttagtttacattatacattttcctaataaaaattattttgacaggctgggcatggtggctcatgcctgtaatcccagcactttgggaggccaaggcaggcggatcacctcaggtcaggagttcgagaccagcctggccaacatggtgaaaccccatctctactaaaaatacaaaattagcctggcgtggtggcgcatgcctgtagtctcagctgcttgggagactgaggcaagagaatcgcttgaacccaggaggcggaggttgcagtgagccgagatcacgccactgcactgcagcctgggcaacaagagcaaaactccatctcaaaaaaaaaattattttgacttcttaatctttagattataatctgatagttttagtatttgaagagttggacttgttagagataaagtcttgcagaactaccagttcctttgtggtttttcatgtaaatactaacttaggcccttctagtcattgatttatcatttgatgtttcaatatgtgtctatttgtaatagtattaaattttaaatgagtgatttcagctgaagtagagtgttgctgccagcccagtattttgatctaatttccccaagaatttcatgaaattagaaatccttaccagcttacaaaaaaaatgttacatagaaaaattttcagtaaattcaaagaagtaagatcattttggggatctttaaattcctggtcaattcctgactttttttttactgtatggactgtcttgggccactctttatggtcctagattaccttcatctagtttgactgacttagttttggaaatcttcctcaacttcaaacctgtaaatttaaagaataaaaactgattttgctctcaggtaaaagaaaatgtaatcaggactgtgaccctgatatccttcaagtctgtaatgtattcaaaagccagataaataaacttgaatgatgtttaatcatctgaatttcctgaatcatcattccccctaccacctccctaccctaaccaccatagaagatccggacttagtggtattggactggaatgataaaaactatccagggaaggccgagcgtggtggctcatgcctgtaataccagcactttaggaggctgaggtgggtgggtcaggagtttgagaccagcctagccaacgtggtgaaaccccgtctctactaaaaatacaaaaactagcggggtgtggtggtacatgcctgtaatcccagcagttacttgggaggctgaggcaagagaatcacttgaacccaggagtccgaggttgcaatgagccgagagcacgccactgcactccagcctggatgacaaagcaagactctgtatcaaaaaaaaaaaaaaatccagggacaaaagaaacttccctaatctcactacccgaagatttagggacattttttggtgttttctctttttccttcagtttcctttggtaactgtagctaaatactgagtgatttgttctttagtttgccttaaaatattgactgtttccacaagcttgtgttttcattgttgttgtacagaactaggtgcaaatgacacagattaataaaaggttggaaatatgttcttttctctcctctttaggatgatgactttgagttcactggcagccacctgacagtaaggaatggctactcgtgtgtgcctgtggctttagcagaaggcctagacattaaactgaatacagcagtgcgacaggttcgctacacggcttcaggtatgtcactgctttacaaaaggtaagagagaactctcctgaaacaggactgatcttttgttaggtgcgacctatcaggtacatttcctgatagagtgtttatgacaccataggtaaaaattggcatttatagacagttgagcctatagagtctttggtggttctaaccctatcattttataaactgggaaatcgaagcaagttttagagtttccaatttgtgcatgagctagttggatattactggtcgagcatccctaatctgaaaatctgaaatctctaatgccccagtgagcatttcctttgagcaccatgtcagtgctcaaaaagttttccattttggtgacccagtgagtttggatctagttttgttaagtatattcataaataccaggattttggcccctgggctccactaggacccaccccttatatttcaccatccgcattttggtctttggattcattttggctttttctatgcatttgggctaattcgcttacgtttggttcctagttctggagcagtcctgctaataagttgacttcttcagagatagagtttccctgtgcttgctatggggataggctcaatgctcattattattgctggtttcaggctacatttgatgtaaagtgcagacaactgttggattttgaactcctcaagataactagtcatctccctctctgagaacccatgtatgactatgtaggcatgagaaatggagacatagccatcaatcttaccctgcgctgcccctttccttggagttactgagatcaccacagatgttttggttttttactaacaatcagtgaaacagttttccatttaattttcccatcagaggcagcttgtagttgacagtgctgagaagatctgcagccttgagccttttgcaggcagacggagaacagtgagaatagatgttgtgccattttctcgagttctgcagccatagaaaatgagcatgtactgagctttcatatttattttgagatatataatttcaaaatatatatagtatataaacagacattcattaaaaaacaaacgaggaaaacgatgttaacataatttcagtaccctctctgaggtcagctttgaactcattcatactctgacaagctgagaatcactgtgcattctcaagcatagcacgctccacagttttaggctgcatcccccagatctgcatcacagccttcttgtagcattcttctgttggtcgatagtgagcagctaaccacagtcagaagacattggttctattgggatgagcactttattctttatttttggtctaaatgtacttaacttgagtaagtggtataaggtcctttcattagtctagatcaccagtgtatcaggagggtagtgtggggatgacagttgaggattctgaagttgactacaagggtttgaatcctggcacttattacgtgtgtagccttagatgagttatttcacctctacctcagttttcttatgtgaaacatgaaggtaatgaaaatagaaaaatgagaattgagaaatggatgtccatctgttgtacactaaatgttcagtgtccttatcagtgccatattcatcaccactagtcttttcccacccaacctctgcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcagattagaagagactttaaggaagtctgttgaagccagtattatctggcccctgtcactggctcatgtgcttctttcttatggtaggtggtgttgtgttttgatcgggtgttctgggatccaagtgtcaatttgttcgggcatgttggcagtacgactgccagcaggggtgagctcttcctcttctggaacctctataaaggtaaatgccttctaattttaatcttttccatatccttacaggaatatagaatttgaaatattttgggttttctcaatatatatgccttaatttctctctttattaactcaacaaacaattcctgaaataccttctaggtactggggtataaaaatacctgccttcaaggagctcccaacttagtggggatacagtaagcggggaagcaggcttagaacagggcagtaggtggcctgatgggctgaacgcccaggttactggaggtccactcagcctggagggataggcccagggaggcttcctaccaggggaagcttgcgttctcattctcagactgacttgcccctgattctttgattacttctcttactatgtgtttatgaaattcctacctcctgttcagttattttcttttgtaattggacttaactgtatgtagacttgtaatatttgtaccccacctcattccaagaaaaggctgtaaaaataagacattggccttgtcagtgcagacacatcagctaaccgttggcttgctccccatccccagttctttccattactcctcactgcccagtggtgaatggtctttcacaccccagagcctctaacttcacagagggggaacttggctccctgagcacattgctttctgagagcagcagcgtgtcttttcccttccccatccaggctgtcaagtcctgtcagtgctagccttacaatctcttgcaaacctatttacttttttctattgcctacctcccagtccaagccattcttacctgttgcctggacggttaccaatagctactactgctattcctgcttcttttagtgactttctactgctgaaagaaaatgttcaaactccttatcttggcccatgctaaggttcttcattatctagctcatctctacttccttgtccatccccagattccaggcacattcggctgttctcacatcctggaaggcaccatgctgctttctgcctcagagcctctgcgtgtactgtggtctaggcctgggggtgctgcttctcccaccccctcgacccccttccttcccaacctgtcttactcagcattcaggtcttgacataaatttcaaagtatttcaaagacgacttccaggacacatctccactgccccaaatgtaaattaaataccccatattcttttccgtgtagcctacgtttttcttcatagcttttaagttaataattgtctgtgtaattttgcatctgttgctctattggagtaatagtttatatcatattttttatcccccttttctagtactgtgcctaccacctaagtctgttgcataattactcaccggatgggtgactgaagacagtcctgggcttggaggggcctgggatggctaaaagggatgtagtcattgtcatggagctatccaaggtagtcaaggttaagaattctgtgccaaagtaaagcgatgcttaataattcccttttattagcaagatctgaaattatatcttcagaactgctgtattttgccaggttagaagcagtgaggtgcctgagaatcttacttcactctagtctgccagctcctactggctggtgtctggcgacaaagagttctgtatgctgtttcagaaacataatctgtctcttcgcatttgaatggtactgcgtgtgtcttgtcatcagatttcagagcaccaggaataaggtggggcctgataaggaagtttttgaggaaagtctgtaggaaaaccctagaattatcctttctgtttccccagctccaatactgttggcactagtggcaggagaagctgctggtatcatggaaaacataagtgacgatgtgattgttggccgatgcctggccattctcaaagggatttttggtagcagtgcagtacctcaggtaagtaggtaggtggggcaaggagggatctagggttcagactcaaccagggtttaatgtatttgcagcatgttcttggtcaggacagtttaagctagaattgaggtctgtgcttttacatgaataattaatgtttggagttcatggcctaagcgtggggttcagaaaaccccccaggacaagagctggggagtctgaaggctgctagctgcatttctcctccggctttagagtcacaccagatccctgacattttagacaaaatggccaaactccagtgagtatctccgggaagttttcagagaacctcttggtactttttcgtgttctttgaaatactttaaccctttaggattcctttgaagggaaggatattgtgaatttataaaagagaataaaggccaagccctgtgtagatctctggattcatagacaggaaggcaacatggaggggcatccttcctgtctgaagtccttttgtccatgtgtgttttaaagcaggcattcatcacttgatcactggctctcacatgttgcccctctttctcttcacttgcatctccacccaccactgcttttccacctttcaaggattgatttgtgcttggtgtctcgtaatgacttttgctcctggtttttcttttagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacaggtgagaagctggcaaactatctgggcttatttgggaagaggccaggatctcatgatgtccctgattttttttttttttttcagattttagtcattccatcttcggaccctttcagataaccaagagcagagttaaaaggatgggcagcatttctgatttctcataatttggttttgtaaatctaggcagtctacattcagaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagctgcgaggcttaagtgtccctgatcaccaaatgtcctgtgcttcagggtagcgaggctccctcccagaaggtagttatacatgagggaaggacgctttacaactgggtatctaaactgatgagaacacatgttaagcatcactttaggactgagcctaggtagagttttattgtctcatttctacttgtcaattctgggaaagtgcctactgataagggagactcttcgatagaatgatgaatagtaattgggggggtcagcctttaaaaaggtcaacagcaatttaagtacttagcaatttaagtacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggaagcttaaagtctaaaatgggtacacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagattgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttga

SEQ ID NO: 9060 - DNA, 170 bp, Homo sapiens
tttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatg

SEQ ID NO: 9061 - DNA, 170 bp, Homo sapiens; identical to SEQ ID NO: 9060

SEQ ID NO: 9062 - DNA, 5611 bp, Homo sapiens
ctttattttcatgatatctgtaatcactgctacaatcagctcacctgatcatctgtgaattcaggtgttcagagcctcctggtatgatgttattcaggtagtgtccagctatatgtgtatgtgtgtgtgtacacgtgcatgtacacacagctgtacagtgtgtgtatatatgtatacatatatgtatgtgtatgtgtatatagagagagagctgagagttattctatttattccttttctctcctaatctgaaaatgggtgttctgtattttgggtggaagaggcatagaaggggatgtgtgttgtctcttaagatttctatatcatgtggattggaccaaaaacttctaatcacttatttagaagggttttataagtgtctgtccatgtgtagcctattcgtgcatgttgtgtattatataactaaggaatagatgtagaatgtgctatttctggttgagaaaaatcaccagaatgtttggtgtatctataaggcttttgtgtttgtttttccccagttggctgaagttagaattgcttgactgacacttcattgctatacatgaaggggcactttaaatcaggaaaatctctcagcttcatagaacgggtaactagtgcaggatggggaaatgttcacagacatcatctgtatgtggttgtgcatagaaagtaaatacatggcgtaattaactcagctgttctagctgcagtactgctgcagtgatccacccacatttaggatgtgctgacagataagctctttgcctacaatacatggataattagtgctataattctggatagttcctttttagtactgttttatgaagctttatcaacttggcttcatgatcctcactttgattgattttaagaggatggataacacagttatctctgtaatgttctgtcccagtatgtctttgggtcaccagttaccttcttaaaatatgtgctttaggtaggtgttattacatatctgtagacaattggtatatgaaatatacacatcctgtgccccaatatggtgcattatgaaaaacaaaatcattttctaaaatgcattttttgagcattgctctatagaagggaagggtgatgagagaacagaactggcccctgtacaggtgtcattaatctggttgtatatgggttataatatgtaatacaaaaagctcattaagtatgggactacatggagagggaagacagtttcatttatagctactggggctaccaggacccttgctgactgcagcctggttgtgattagttcaggttactaggtgttctgatggagtgggacagtccaagtccagtaactgacattacgttttatgcgtgtgcagtttggtataacgtggagtcagtgctctaacgacacactatacttctatatgcttttttctgtgaattttccttggtacatgagagaaataagtactctcatcaacttatgataaattggactattaggaataaaacaatctcagagcagctcctaaacaagagaataaaaatgggccatcccagcacttataaggggagcacatcttgtaatgaaagtctgtgcctattgttaatgattaccaatgcaaactgcagaaatcagttgacattgtcccacaaggaaaaagtgatgccagtaaagtgggggaagagatggtaaataattctagaatgagcaaaagtgcttaattagtacagtatactcaaggtcttgcataacccacactccacgaaaaccgcatcgtaaacagagagtgaacagcacctctccattgctacatctccagaatattgttcggttatgttcatgtggttatggagcaataagaatatataccattaatttttaggtctttcaaattgttcaccaagttttgtgtttgatatttatgaagtgatctttaacacatctgcattgttaatttaagcatgcacagaaatttgggtaatgtttgagtagattgccaagcgctactgtgattcatgaatgaatttctcatagtcttctgcctgcagttttatagtttgaggggcacccatatttgtgggttagagttagtaagaatatgaatccagttatcaaagtattcatccctgaggttttgagttttattgtggtggtgattttctcatgagaaggtagacaacacttcagtttttcttgagggggaaaaaatgtacccgctaaccttttttcacccatgatttgagccctaaaacaacagcctttatgttttcagtgcaggatttcttggaatttcttgcttgtatcaatcctgatgatagccatcctgaacagatgcttctggtctgttttcctggaatagcagacatccttttgaacactaatgatgccaggaagagagtaaggctagaggaggagactcattttaaccccagtccagtggcttgtccgacaacaggccatttccctttacattcctccacagacagaaatggctattaaaaatgttttaacctcatgtatgaactgaatttaaaaaaccactaaagtgatactttatacttctgttttactccctagtgggttttctttaatttggatttttgttgggatgtagcttttcctagactgtatttctgtagctctttttctctggtgtattcatggaaagcatctactgccgcacgacactagtactgtgccttctttcactgccctctgctctgcagctctcacccagcttggctgcttcaagtctgtgcagttgacttggctgtactgaaaagtgaacagcatggattaactcatcctgctgctgagggcagtgcaaacaggtgcttattagaggtagtgacttgcttaattagtgacactcctaatttctactatggataatttcaaagtagaatcactctatgcttagagttttggcaccaatgctgtagggcagcagaatctattctcagtaaaataacttatggtttattagatattctgtattggattttaccagcttgacttttactgctcagatgctttctttcccccccttagacgctgtaattctcttgggaagagtaactattcttaaggtttttacagatacccaccttagttgtaaattggatagtttatatttctgggactttttaaatgaaaatgtggaatgttaagttacaaaagacttttcatcagaaaatttcaaacaaagtaaacatggcgttttatagtcctctaaaatctaggtgctcccacccaccaaaggcatatcctgcaaagggctgtgaactatcttggtgaactgtcttgggtcccctttccatgtatgttttcttgtcactgaaaacaaacaacgctgagtttatcaagaaaatttaaattgggggatcataataattccaaccaagtgacaactctgacatcaaggttattaggagctgtacatccaattcaagttttatttgctgctattctgggagaataaacttgtatatggagaataaactaataaacttgtatcgaggaaatccataaagttataaattagcctgaaaaatatttcaggtaatggtgtggattggcctgctttgactctcagccaccaacagaaatctttgtcacctttgttcctcagctaaaagtaattttgttataaacacaaagtgactttaaacaggtaaaaaacccattcctatttttgtacattaccaaaagtttttcatatacctacagagctaactaattacaactgatttaatccactcaagtttagaccagttaaacccataggatcctgtatggttatcaatgtgatgccttgcttttcataaaataggtataattgggtcatacacttgacgagagggtgactgtttctaggggaagaaaaccctttagattgcaggtaactttcacttttttttttttaatatacactttacatttgtataaattatgcagggtactcctaaccctgtagaaatgtatgacctctcacaaagttgagatttgatccaaagagaaatgcaagtataaaagaattagatacttattatcttttaaggtttttttttttttttggtagagatgggggtctcactgtgttgcccaggctggtctcaaactcctggccacaagtgatcttcctgcctcagcctcccaaaatgctgagattacaggcatgagccactgtacccagcctttccttataaaattcaaagagaaaatttctacacctttatccctcaaataaaacaagtgctcagttcttaccgtgcccttgcaaggtctatatgtaaaagaaatctgaaatttagctgtagaataaaacttgataaataaaaagaaaaaacatacatttctccagttggtttgctctttgcttgttgaagtaataaaccgttttaaagagaaaatacttgctgtaaacccccagtgccttcaactcttttggcagaatatttttaaagaaatccagcaagcaaactttgaggtgctaatgaaagtaaaggaaggtggtatttctagttttggcagaaatgaaaagtgtctcacaagagacatcactacccacgtggggtctggctgctttctaccaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaa

SEQ ID NO: 9063 - DNA, 632 bp, Homo sapiens
tggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccct

SEQ ID NO: 9064 - DNA, 296 bp, Homo sapiens
ccgggtgcggtggctcacgcctgtaatcccagcactttgggaggccgaggtgggtggatcgcgaggtcaggagatcgagaccatcccggctaacatggtgaaaccccgtctctattaaaaatacaaaaaaaaattagccaggagtggtggcagtcgcctgtagtcccagctactcgggaagctgaggcaggagaatggcatgaacccaggaggtggagcttgcagtgagctgaaattgtgccactgcactccagcctgggcaacagagcgagactccgtctcaaaaaaaaaaaaaa

SEQ ID NO: 9065 - DNA, 6248 bp, Homo sapiens
tgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaacttatatttcataccctaatttttctttgaaaatattcaagatttgtagcctagtgtgttctattttgtgtgattgcttgaatgttttctgattttattgggtaaaagtttgcctagtaatgatctttcagcaattcattgaaataattatttgaagtaatcttgcttcagatttaatttgtgatgtacattgttgtacaagccattttagtacaggtgtctcatttatgtagttgaaaggtgactgtggaatttcttttgttttttatgtatttccattcagtctctttatatagtcacatgtttcacaggggaacttgtccactggaacctaacatagtacaaccttttaatatgcgtatcttaaaggaaaatattataaaacaagatattaatactaaagtgttaacattaatatgttgttctcatggaagaaaagtagaaaatgtgataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgttggaatactggtagaaataaccttcccttcctccactgtgcagtggaaaaaaaactcccgatttatactgtatataaattaggaaattatgttacatatttacatttttaaaaatataaaaatgacatattattttgaagtgattgtattatagtttctgaagcttatgactggctataaatataacaacatacccatgagaaaccagaccaaaattgaatatatatcatcactgtgaccttgaacttatagtcatttgggataaaacagagtgtgccttgaaatgataaagagtgccctgcaattttataactgtacattttattatgggtggtcctctcaaattggccccaaatccttgtcttcgaggttggtgaaataaaagtttaaaataaaagttgactggtatttcctttagtatttccagaactattgctgtagaggcctcccttaattttcagagttctcattttgaattaaagtagacttacgctacatagatgtagaaaattaggtttggcttaggtttctgaaaaaatattctaggagaaggtggtagcattgttctgaacttaccacacttggaaaaactaatcttcaaatgtaattttttgtcttattaatgagtaatctgtcaaagacatgaattctttgacttgtgctcattctttctgaacttattgaggcttatatatatcaaataaggttaatttacacaataattatttttaataattaataaactcattcatgtagtatattttaaaacattatttcctctcatttttccttctcttttttcttcctatatatttttaaggcttcaagagaaaacgggcttcagtttttaaaaaaatgtagacttgcatttttactgtgcttatttaaaataatggatataatttatattaaggtccaaattattttattcacaggataatcatggtctctgataaaagatgcccacatttctgtgtactcacagttgttgtatatttttcaatttcaattttgaaagtaaactcaacacattgttttcccattttacctccactacctactcgccagacaaaaatatagatttctctaaaaacacatacaaagaaaatgtctttccttaaaacatgatcttattgacatgaaggtagtttgagcaagggtatgtaataaaataaatggctctcaac

SEQ ID NO: 9066 - DNA, 306 bp, Homo sapiens
caagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttctt

SEQ ID NO: 9067 - DNA, 357 bp, Homo sapiens
cttgctgatctttccatttaaacatgcatgatctccagtactttgtacaatgtatagtatattaaatacatttatgtgtaattttgtgtgtatttttatatggtataattaaaattattacatttatgtgattgtaattcacaaaaagtactacttactatattctgtagagtgtgttgtgaatgtttttacctgtgtttgagcattatggtgtaggtttaatagatgaatatttgccttcagtctctgctcaggtattaatgtgtagtaatttttggtgctttctttttaatctgtgataatctggtgttctgaatgttcaaaaataaatttggttgaatacgcacatggtaaaaa

SEQ ID NO: 9068 - DNA, 1041 bp, Homo sapiens
agcactgctgggcctgcaggtctctgtccagctgcagacaaagatctctcttctgcaggatggggtttgttaaagttgttaagaataaggcctgctttaagagataccaagtgaaatttagaagatgacgagagggtaaaactgattactatgcttggaaacgcttggtgatacaggataaaaataatacataacacacacatacaggatgataatttgtgtaacagagatatcatttgtcagattgcttatgcccttatagagggggatatgatagtctgtgcggcatatgcatatgaactgccaaaatatggtttgaaggttggcctgacaaattatgctgcagcgcattgtactggcctgctgctggcccgcagccttctcaataggtttggcatggacaagatctgtgaatgccaagtggaggtgactggtggtaaatacaatgtggaaggcaatcttggtcagccacgtgcctttacctgctatttggatgcagaccttgccagaactaccactggcaataaagttttgggtaccctgaagggcgctgtggatggaggcttgtctgtccctcacagtaccaaacgattccctggttatgattctgaaagcaaggaatttaatgcagaagtacaccggaagcacatcatgggccagaaagttgcagattacatgcactacttaatgaaagaagatgaagatgcttacaagaaacagttctctcaatacataaagaacagcgtaactccagacatgatggaggagatgtataagaaagctcatgctgctatacgagagaatccagtctatgaaaagaagcccaagaaacaaaaaagaagaggtggaaccatcccaaaatatcccttgctcagaagaaagatcaggtaactcaaaagaaggcaaactccctcagagctcaggagcaggctgctgagagctaaaccaaacaattttctatgaggatttttcagataaagacaataaactgatggatagcaacaacaacaacaaaaaacagaaatcaaaaaaacaaaaaac

SEQ ID NO: 9069 - DNA, 98 bp, Homo sapiens
ttttttttttgagacagagtcttgctctgttgcccaggctggagtgcaatggcacaatctcggctcactgcaacctctacctcccaggttcaagtgat

SEQ ID NO: 9070 - DNA, 3524 bp, Homo sapiens
ccagtgttactaactgtaattctatcctgttcttcactggggaaaagcttttccagtgtgctgagacagttttggttatgtaactgttaaaatgatgacagtcgtgtggcctgcggatagcactatgattttctcacagtgagttgaacctggcaggtgttgccactcacatctgaccacatttataacactttctgtactcgtatcttgtgccagtagtctgctagtccagattcatgttcctttttctcttttgaaattaaactcatagcctccaaaaatttgcatttgccctgttttgaggggggagaagtggagactattcatgatgctcaatatatcatagtattaaaatatacattgcaaattcctttgtatttatgcccttttgaaataaaaatgaatgttcttagcaaactcaaagttcttgaactctgtagtttacacatccttagaacagcactaccttgtatgtgatattcaagagactgactttctaaagagtcttagagccaagctttaaattctgatctgttaatatatatttcagtagttgctaataatgccatacctcttcttcactatgctgatcccacacacagctttctttaggagaaggaatacctgtacatatgaatgagaaaactgtagaaataatagttcggacccttttcaaaattgtattcggaattgctagtttagcctctactaaaccatacttggttcctgggcctagtgaagatttgatcatttaatttcgtgaaagccaatacattctagcagcatattgatattaatggccgttgtgaatattgtccgcatctgtgtttcgtatggcatacagtgaacaatacaaataatttcaagaagtttgattttgactactatggactttcattttctagttgttttctttttttcttatcattttcctttcctttttcttcatgttggaaatctttcttctgctgccttcctctgtcaattaaaaggaaaatcccacctaaacggtaatctttctgttgaatacattctaatagcattattttatattaacattataagtgcagttttttacttataatttaaaaggtttttttgttttgtttttttgtgaaacagagtctcgctctgttgcccaggctggagtgcagtggtgcgatcttggctcactgcaacctccacatcccaggttcaagcgattctcctgcgtcagcctccccagtagctgggactacaggcacgtgccaccattcccagctaattttttgtatttttagcagagacggagtttcactgtgttagccaggatggtctcaatctcctgacctcatgatccgcccacctcagcctcccaaagtgctgggattacaggcgtgagccaccgtgccccgcctattttagatagatcttttaaaaacttgagaccgaatatacttgcaaagcaaactgtttatataaaaggaatattgaagattaatcatataaattataaataatttagtagaagatattttatccttttaatataactttacaatttttaattttttttttctccttaaccctagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacattgtaagtgaacttctaggtatcctaatggatgaatgtttttttgccccagagagtggcattgagactgattggtagttgtcagaaaacaaccccgagacagtttgcttttaaattatgctgtgcataacatgggtaatataaataagaccccaggccgggcacagtggctcacgcctgtaatcccagcgctttgggaggccgaggcaggcagatcatgaggtcatgagttcgagaccagactagccaacatggtgaaaccccgcctttactaaaaatacaaaaattatctgggcatcgtggaagccacctgtaatcccagctacttgggagcctgaggcaggagaatcatttgaaccggggaggcagagattgcagtgagctgagatcacgccactgtactccagcctgggtgatggaggggctctgtctcaaaaataaataaataaataaataaataaaacaccagcccaggagagtaacattgaaaagtatagatgtaatagtagttgtactaactatagtttatggccaataacaggctactatggaattcgttttagtggctccatggaagttgaacatttgatattgattggtgcaggtaattgcttaagtgattttgaagttaaacaaaacaaactaatattggatattgcttattatatttcagtgaaagaatctgaagccgataatacaaagaaggcaaagtaagttctctatctttttgacaattgaatgttttcctttcacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataagaagtgggcagaagggtatatttcggggtgctttgctaacaatacatatgtctgtgaatgagctcgtgtgttgtcttgcagtcactttattttgaacataaaaatgtatgtttccaagagggatctgtggattaattgctatatttctaaaaatgctctacccttaaaatttttgccacttaataaaacagctatgtgaaattaagcttttataaggcatgttttctgcatgatggaattagtctagaacctttttccttctatttcttatgactcttctatcactctttttttttttttttttttgtatttccacagggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttggggatttgtatctgtttttgttgggattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattat

SEQ ID NO: 9071 - DNA, 4226 bp, Homo sapiens
ccagtgttactaactgtaattctatcctgttcttcactggggaaaagcttttccagtgtgctgagacagttttggttatgtaactgttaaaatgatgacagtcgtgtggcctgcggatagcactatgattttctcacagtgagttgaacctggcaggtgttgccactcacatctgaccacatttataacactttctgtactcgtatcttgtgccagtagtctgctagtccagattcatgttcctttttctcttttgaaattaaactcatagcctccaaaaatttgcatttgccctgttttgaggggggagaagtggagactattcatgatgctcaatatatcatagtattaaaatatacattgcaaattcctttgtatttatgcccttttgaaataaaaatgaatgttcttagcaaactcaaagttcttgaactctgtagtttacacttccttagaacagcactaccttgtatgtgatattcaagagactgactttctaaagagtcttagagccaagctttaaattctgatctgttaatatatatttcagtagttgctaataatgccatacctcttcttcactatgctgatcccacacacagctttctttaggagaaggaatacctgtacatatgaatgagaaaactgtagaaataatagttcggacccttttcaaaattgtattcggaattgctagtttagcctctactaaaccatacttggttcctgggcctagtgaagatttgatcatttaatttcgtgaaagccaatacattctagcagcatattgatattaatggccgttgtgaatattgtccgcatctgtgtttcgtatggcatacagtgaacaatacaaataatttcaagaagtttgattttgactactatggactttcattttctagttgttttctttttttcttatcattttcctttcctttttcttcatgttggaaatctttcttctgctgccttcctctgtcaattaaaaggaaaatcccacctaaacggtaatctttctgttgaatacattctaatagcattattttatattaacattataagtgcaattttttacttataatttaaaaggtttttttgttttgtttttttgtgaaacagagtctcgctctgttgcccaggctggagtgcagtggtgcgatcttggctcactgcaacctccacatcccaggttcaagcgattctcctgcgtcagcctccccagtagctgggactacaggcacgtgccaccatgcccagctaattttttgtatttttagcagagacggagtttcactgtgttagccaggatggtctcaatctcctgacctcatgatccgcccacctcagcctcccaaagtgctgggattacaggcgtgagccaccgtgccccgcctattttagatagatcttttaaaaacttgagaccgaatatacttgcaaagcaaactgtttatataaaaggaatattgaagattaatcatataaattataaataatttagtagaagatattttatccttttaatataactttacaatttttaattttttttttctccttaaccctagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacattgtaagtgaacttctaggtatcctaatggatgaatgtttttttgccccagagagtggcattgagactgattggtagttgtcagaaaacaaccccgagacagtttgcttttaaattatgctgtgcataacatgggtaatataaataagaccccaggccgggcacagtggctcacgcctgtaatcccagcgctttgggaggccgaggcaggcagatcatgaggtcatgagttcgagaccagactagccaacatggtgaaaccccgcctttactaaaaatacaaaaattatttgggcatcgtggaagccacctgtaatcccagctacttgggagcctgaggcaggagaatcatttgaaccggggaggcagagattgcagtgagctgagatcacgccactgtactccagcctgggtgatggaggggctctgtctcaaaaataaataaataaataaataaataaaacaccagcccaggagagtaacattgaaaagtatagatgtaatagtagttgtactaactatagtttatggccaataacaggctactatggaattcgttttagtggctccatggaagttgaacatttgatattgattggtgcaggtaattgcttaagtgattttgaagttaaacaaaacaaactaatattggatattgcttattatatttcagtgaaagaatctgaagccgataatacaaagaaggcaaagtaagttctctatctttttgacaattgaatgttttcctttcacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataagaagtgggcagaagggtatatttcggggtgctttgctaacaatacatatgtctgtgaatgagctcgtgtgttgtcttgcagtcactttattttgaacataaaaatgtatgtttccaagagggatctgtggattaattgctatatttctaaaaatgctctacccttaaaatttttgccacttaataaaacagctatgtgaaattaagcttttataaggcatgttttctgcatgatggaattagtctagaacctttttccttctatttcttatgactcttctatcactctttttttttttttttttttgtatttccacagggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgaca

SEQ ID NO: 9072 - DNA, 102 bp, Homo sapiens
agtggaaggtcttttagatgttttacttgtggaatcatgatattaccatattaccataagttatagtattttttatgattttttgcataaatgttactgatt

SEQ ID NO: 9073 - DNA, 106 bp, Homo sapiens
aggctgaggcaggagaatcgcttgaacccgggaggcgaaggttgcggtgagccgagattgcaccattgcattccagcctgggcaacaagagcgaaactccatctct

SEQ ID NO: 9074 - DNA, 102 bp, Homo sapiens; identical to SEQ ID NO: 9072

SEQ ID NO: 9075 - DNA, 3179 bp, Homo sapiens
gggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 9076 - DNA, 6223 bp, Homo sapiens
ggctggttttggttatggattgcccatatcacgtctttacgcacaatacttccaaggagacctgaagctgtattccctagagggttacgggacagatgcagttatctacattaaggtaatagctgtagtcttcttgatttaatatttcttttgatgataagaacagatgtccatacttaactgtaatgaaatttaactctaccacatgctgtttaaatagaaaaaaactatggttttttgctggggatctcacccattttgatagatgatcccctaaaactatggggaaagagatttgtatcctggagtgattaggactctgtctattaataggaaaaaaattgggttaaagtagagaatcataagttatatatcatacaagtttaattttaacataaaacacatgaatggacattgataacgccaaacttttgatgtactgccaaggctttttttttgtatatgggtctgcagattggagtgtcacattgtcttttttgcaaaagctgtactgacagtgcatcattttagtttctttaaaccaacaagtgcatactctttttggacttttatgcagtccttaacagatacctcctgactgatttgacagcaagttttatgtgactttccttcatgagtctttccagaacattcatcttagttttcaagggaacattcccctttttattctttgcttatgtaataaattttgtaattatcatgacagaattgtacaaacagatttgggaacaagcacaagtgactcttggtaagcatatagcttacctaatggacacagaagcacttagtctgcttgcctggagtgttcaatgcattaaggagggttccacacattttacatggtggaaaaacactaggttccatcattccccttcttcggctaactggtggctgtttatgcctgatttagtgactctagtttcttgttctggccactagatggcatctattttataggaaatgttgaagaatttatattggaaaaaatatctgaaaagactaaattctttctagatggtattttttgtttttttaaccatgtcaattgcgagggaaaagggcaacatcaatgcaatgtttttcttttttttttttttttgagacggagtcttgctctgtgtcacgtaagctggagtgcaatggcatgatctcggctcactgcaacctccgcctcccgggttcaagctgttctcctgcctcagccttccgaatagctgggattacaggcgcctgactaattttgtatttttagtagagatggggtttgaccacgctggctaggctgatctcgaactcctgacctcaggtgatccgcttgccttggcctcccaaagtgctgggattacaggcatgagccaccacacctggcctagtgcaatgtttttatgacaaaatgtaacattttgatctagcccaggagtgtccaatcttatggcttccctgggccacagtggaagaacagctgtcttgtgccacacataaaatacactaatgatagctgatgagcttaaaaaagattgcacaaaaaaaaatctcataatgttttaagaaagtttacaaatgtgttgagcttcattcaaagccatcctgggccgcatgcagcctgtgggctgtggattggacaagcttgatctagcctgtagatcaagaaattctggaatatttagagaaatatggaggtgaaaggttttttgttctaccttagggaaaatagaagataagaagtcttagagaatcattaaaattgtcaacatcaaagactttagcattatcagaatgagattttcttgttcagggtgttctgcatcttaggaaatgcctttggcctgggatggaaatactactgaaaaatcctaacttgaagaagataactagaaatgtagtttatctcaggttccagtgacttataggaagctgaaatacaatggagaattactggtaataatatatggaaaactgaaatcatgcatgatgcagaaatcttgtgcacagtgactgaaattggaggccggagaagacacagattcaaacccagggccaataaatgttcacgaaaaagctaagatgccttagacatagatttctatttattaataatgttataatgagtttttaaatttttatgtatttatagagtcaatatcttgctttgttgccaggccggagtgcagtggtacaatcataattcactacagccttgaacccctgggcttcaagtgatcctcctctctcagtctcccaagtagttaggactacacccatgtgccaccatgtccagctgatatttttattttttgtagagacaggatcttgctatgttgcccaggctggtctccaactcctgagctcaagcaatcttcctgtgtaagcctcccaaagcactgggattataggcataagccaccgtgcctggcttgtgatgagttttttttaaagcacagtgactatgctgaaaaaaacactatttcttctagtaaataattaaaatagagttcattaaatttatgtgcatctattaagatacatatatcgatttgtatgcttttacatttaaccaacttcttcagttagccaactctgatctgggtcatgttttgtgtaaaatttcagtccagcagcttccaggatggctggggaattactgtaagcaacaaactcagtcaacctgcacatcagtcagtgccatagatttcataaataacacgtttcaaatatacataccatttaaaagtatatttaggtggtataaggattaataagatactaatagaatattatttaatttgtcgtaacctttttgccattgtctattttctcaaataatgaattctaaaaaatgccagacttaataggtcttaggtttttctttttcaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 9077 - DNA, 212 bp, Homo sapiens
catatgggtaatcagggttgagttaggtagtttgcaaacatgacttttgctggaggaacttttaatcatgtcttattaatttctggtcccaataattaattttcttacagtcaaacccaatgcacttgaaaaataatataattaatactgtgtgaagaattttttgcatgttaaaaaaagcaaaccactagtttgcttagttctggcattca

SEQ ID NO: 9078 - DNA, 212 bp, Homo sapiens; identical to SEQ ID NO: 9077

SEQ ID NO: 9079 - DNA, 3981 bp, Homo sapiens
aatcttaactgtttattgatttggagattgtatctcattggtaaagaacagttacttccttcacagtctaaagacaaattgtgtattattctgtgttaaatagcatggcactgttgatcaggagtttacttctgtctcattacaatgtgaacttgttgcccataaaataattctcttaagattgatacatcctgactatgtactaacatgtcatgtcagtttattattttaaatagaatgtgctaataacatatcattttaaggtttatgtgaactatttctctgaaagaataaaaatttgtcactgtataattgaacatatattgcactttgtattcacaggtttgggggaggcagatcagacatgtaaactatgtacttcttgctaattgaaattatttctacattaaacagacttgtagaatttacttatacatgcttgactttttaattatcttttttctccttttcttaaagatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaagaattcagtgtcacta

SEQ ID NO: 9080 - DNA, 624 bp, Homo sapiens
agggatctgcccccatgacccgaacacctccccattaggcccctctccaacatgggggatcactcatttcaacatgagatttgaaggggcagatatccaaaccatatcagtctgtaaaatattttgactaggatttcagaattttttccttgagtgctttcacaactcttggccaccagtcttagtttctttatgtagcttccttctgaagaataactcatcctcagaataaatctttcagatatgttttgtgaaataaattttgtaaaataaataatcctaaagttgtctgtgttacatatatatgtgttgaggctaccagaagttattattaaataatttcatgagttttttaatgaccccatttgcatatgtatctatacttgctgaaagcttattttctttttttttttttctttttttttttttttatgagacagagcctccctctgcctctcaggttgaagcgattcccttgcctcagcctcctgagtagctgagactaccgatgtgtgccacgacgcccagctaatttttgtatttttagtagagggagggtttcaccatgttggccaggctggtctcaaaacacctgacctcaagtgatccgcccgcctcggcctc

SEQ ID NO: 9081 - DNA, 1072 bp, Homo sapiens
catgcctcgtctgtttgccgatttaagacaggtttatgtacatcattatcattagaggcacatagaatctagacatgtacttgaaacttagctctctatcctgaaagttgaagttagggttctttgatcctggtgagatgttaattgtaattttaattttcatatgttaatattgtgacttgtattttgtgatgagtctctagaatgattaaatgactatttttttatgaaaaattttttgttaataaaatatctgagggtattttgagtatgtggaaggaatgcctgaatagaagctgatctatcttaacatacctcaagaactccagttttaatatggtgagtgaggagttgactgggaaaaggagagatccaattcttgttctagtccttggcacatacactctctgggttttgagaaaaggatggtcctacaacgattctaagttgttttctcattggtcctacaacaattctaagttgttttctcaaaggcaaaagcatgatttcaaaatgacatcacttgtcagattttctggtgtatggaaagatttaataatcctgcctcttttgaagcctgaaacttacaatttaaagcctgaaatctaccataaggaacttggtaaattgtgtcagataccatgaaaatgcatcttttcatagttaaccacagattgtttatgtaaaggcaaattggtggtcaggttcaaggtaaaatggattattgggttgattagtagccaaaaactaaatgcatgttcaggtcaaaatgaatttgtttgttttagttggtgccattttccttttattattcagaactacagagtgtgcattttattaataggaatgaaagctcatgcttgaggatttgaatagggtggatgtatatattttataaactcaagttgcaaaatatgtaaagtcactactttttaaatagaatataaatgttaaaacagacaaatctatgttatatattttttaatacatgtatcagacttgttagttgaatgcagattactttgctttatggaatttcataacttttaataataaagcagttgttattgga

SEQ ID NO: 9082 - DNA, 24079 bp, Homo sapiens; identical to SEQ ID NO: 6247

SEQ ID NO: 9083 - DNA, 17595 bp, Homo sapiens; identical to SEQ ID NO: 6248

SEQ ID NO: 9084 - DNA, 640 bp, Homo sapiens; identical to SEQ ID NO: 8187

SEQ ID NO: 9085 - DNA, 125 bp, Homo sapiens
acctcgcccggctaatttttgtatttttggtagagatggggtttcaccatgttggccaggctggtctcgaactcctgacctcaggtgatctgcctgcctcggcctcccaaagtgctgggattacc

SEQ ID NO: 9086 - DNA, 640 bp, Homo sapiens; identical to SEQ ID NO: 8187

SEQ ID NO: 9087 - DNA, 640 bp, Homo sapiens; identical to SEQ ID NO: 8187

SEQ ID NO: 9088 - DNA, 640 bp, Homo sapiens; identical to SEQ ID NO: 8187

SEQ ID NO: 9089 - DNA, 654 bp, Homo sapiens; identical to SEQ ID NO: 8195

SEQ ID NO: 9090 - DNA, 640 bp, Homo sapiens; identical to SEQ ID NO: 8197

SEQ ID NO: 9091 - DNA, 640 bp, Homo sapiens; identical to SEQ ID NO: 8198

SEQ ID NO: 9092 - DNA, 640 bp, Homo sapiens; identical to SEQ ID NO: 8187

SEQ ID NO: 9093 - DNA, 639 bp, Homo sapiens; identical to SEQ ID NO: 8201
  misc_feature (88)..(88): n equals a,t,g, or c

SEQ ID NO: 9094 - DNA, 648 bp, Homo sapiens; identical to SEQ ID NO: 8202

SEQ ID NO: 9095 - DNA, 624 bp, Homo sapiens; identical to SEQ ID NO: 8203

SEQ ID NO: 9096 - DNA, 654 bp, Homo sapiens; identical to SEQ ID NO: 8205

SEQ ID NO: 9097 - DNA, 654 bp, Homo sapiens; identical to SEQ ID NO: 8195

SEQ ID NO: 9098 - DNA, 50498 bp, Homo sapiens
gcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcaggtcggtgtcacgtgaccgtctcttccgggcccgcgcgcgcggcgtcgacctggggcctctcgtggtctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacaggcacggcacgcaagcttttggggtgcccagtggctctgttttcaagtcacagccggcccgcagggtgcggacctttccacatctcacttgggccgctagaaaatagaaggtggggaaggagtttcttggggtgcattctgcaagctaccagcctccctcctggcccaaggttggggttaaagcctaatgtgttttacgtgctattgattttatcccatggtaagggagccccccttccccgtactcactctccatgcctttgaccaagataatttggtgagatgtttgcacttctcgtttaaatgaacagtttgctatggaaactagaatctgggaacgatagagataacagtctccagatttttttttttggtacttttatttcaggaaatatccgtgacctgctgatcagcagtgactattctgtcctctcagttcatattttctttcttattcaagttgacagacctttaatgggtgattactgtgtggaagctacctcactaagcaccttgggaatacaaagataaggaaactccactcttccagagtctatcagtgattcacgaccttgctgagaacagggtcattggtgaattttcagaaaacaacttggcagtgattggggttgaacctagttcaccaagggtgaaaataatggactggatgaatcaagagtaaacagtcttttcttgatttgcctacccagacctttggactgtgctatgtgcttgatatacagagatgaagtggatgaggtctttgttcttggtgttcacagactgtggaaattagaagagaggaagcatgtgatggtacaagaattttgacgaggggttgagatgacttaacaatgaaagggcacaggagagatcagagatttgggattaaaatgtgctcctaaggggctggcttttggaatagaggcagaagacttccgcctcttacaaggaaaagtaaaagatgttgatcctgggaaaacttgagatggagtaaaatttagtatgacagatgatctgacgtcagtgaagtgatgtttgaagggtttgggtagggatggattagagcttggctttggaccctaactgaacatcaaatgttcccggaaagtttttacaatgtgactaaggcttggtccccaccccagaccatttaaaccagaatctcctggggatggggacctggttcaacaatgttttaaaagtaacccagagaattttaacacaggactaagcaccattgtgttacagagtggaaaagtggttatttggaagttagagctgaagaaccaaaataacgtgtgtgtgtgtgtgtgtgtgtgtgtgtgtgtgtgtgtgtgtttattttttttccttttatgtccggttcttcattaggggcttacattgtattaatagcagtgggaaagactaggacaaatgattagcacagtggatgtgtcggaaggttcaaggaagcaagaaattaaataatgaatattgattcctgaccgtctaccacataccaggcagtgtattaagcactttatgtatatcatctgtaatcctcacagtaacctagcaaaaattaagcagtgctacatgaggagccagagttctaggtgttagggttggaagaataaagaggtctttagtgattagtaaggaaagttgttagaaaggtagttcagtgagggtcacaggaaggatgtgtgaggcaatcagcatagaccttgaaacctagaggaagatagcaaatgatgggatggagagccagatcataagcacacgtgacatctctgagaaggaagggtaggatctgggaggcaggtgtggaaggaatgattctggtgaatggtgtgggcttgggagggtgggtatcggtgtgtcatggtgtaagaagcacaggacaggaagacctgcagttgggggagtggaataagcacctccgtttttgtctcagtggtgatcttgccaagggtgcatggttcaagacagttgtgtttcagttgagttatatcaatcccgggactccttcaaatccctcataatgaagctgtaggcctggaggaggtccagcaagtaggtattatattaggtgagtttttaaaaataggtaaaataatttggaaaaaaccccacaaacatacgcaggccctgggccccactcccattaattctactctatatagccactattaaaaaccatttattggccaggcacggtagctcatgcctgtaatcccagcactttgggaggctgaggcaggcagatcatttgaggtcaggagttcgagaccagcctggccaacgtggtgaaaccccgtctctactaaaaatacaaaaaaattagccaggcctggtggcgcacgcctgtaatctcagctactggggaggctgaggcacaagaatcgctttaactcagaaggtggagattgcagtgagctaagatcgtgccatggagccaagatctccagcctgggtgacagaacgagactccttctcaaaaaaaaaaaaaaaaaaccaataaaacaaaacaaaaaaaaccctatttatttattttgagatggggcttgttctgtcacccaggtgggagtgaagtggcacaatcttagctcactgcagcctgtgcctcccaggctgaggtgatcctatcacctcagcctccggagtagctgggaacacaggcacacaccaccactccctgcaatttttttttttttttttttttttatttttatttttgctagagatgggattttgccatgttgcccaggctggtctagaacttctgagctcaagcagtctgcctgccttggcctaagattacaggagtgctgggattacaggagtgagccaccacgcctggcctaaaacctttagagtattttgtgagcaataaactataaaatgttagttattagtaatgactgatgtttttaaaagtctcttcttgggtgccaggtccacgttctgaagtgctgtggttttttagtgcttactaaggtaactaccattgatgagcatttattttttccgctggtagtagcatccttctttttcttctttctctgttatataattaattaataattctgcatgatttttacattgttaactttacatgctagaagccaagttgagattttagtaatctgcattttttctgttggtgtttattgttcagctaggataagtgctaacagaagagtagtttagagtgttactgtagtaactcgccaagtttttaaagcattacatatcaattaaactttaaaaatttaacattggccgggtgcagtggctcacgcctgtaatccggcactttgggaggctgaggcaggtggattacttgagatcaggagttcgagaccagcttggctgacgtggtgaaaccccgtctctactaaaaatacaaaaattagctgggcatggtgatgcacgcctgtagtctcagctactcgggaggctgaggccggagaatcacttgaacccaggaggtggaggttgcggtgagctgcggagtgcagccactgcactccagcctgggcgacagagcgagactcttgtctcaaaaaataaataaaaaaaaatttaacatagtgccagttttttttttctgttatttcccattaaattttctgtactaaatgttcaggaatttcttaaaatatgataagaaatcatttcagtaataacatttagcacactaccaaatttatttgatcgtttattacattttacatttgtacagaaaattaaaatagtaactgggtatttggaatctgaaagttttaagtatattttggtaacactgttatttggatttgaatggcacaaggatggggaccacctgttcgggatgttactgaaatctgtttcttacgtttttagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtaaggagcttctcaattcctttgatttgtcaattcctgtgtgaaggtttgtttttccaacctgtgaaagaaacgtgaatgtaaaagagacctaaataaaaggataattatatttattctctagttgatcagctataaatttatataaaacataggcatgtttgtactaatgaaacgtactgtcaacctctatcacattgttaaattaacacttttggtggtaactcaataaaattgagaaaattggaaatcctgtgttacttaaagaattagccatatttttctaacaaggtcacagagatttagggccaaattccagtcccagtgttgaattcatgttcaagtttataaaaattactttgttaatatttaacttacgtggagaactcctgctattgtatactgaaaagaggttagaattagcagattgaaggtgttttttgccctttttctaggaccagtctttttttccattttcctttttttctgctggcaagagatacctcatacacactccctgattgcctcaatcttgagattttcttttctttcttttttttttttgagatggagttttgcttttgttgcccaggctagagtgcaatggcatgatctcggctcctgggttcaagcgattctcctgcctcagcctcccaagtagctgggattatagtgtttgccagcacacctggctaatttttttttttattttattttttttttttgagacggagttttcctcttattgcccaggctggagtgcaatggcatgatcttggctcactgcaacctccgtctcccaggttcaagtgattctcctgcctcggcctcccgagtagctgggattacaggcatgcgccaccatgcccggccaattttgtatttttagtagagatgaggtttcttctccatgttggtcaggctggtctcaaactcccaacctcaggtgatccatccgcctcggcctcccaaagtgctgggattacaggcatgtgctactgtgctcggccctgatcttgagattttcaatggccagcttcctggcacctgaggagtatggcttgccagccatcatatggtttataccgaaacaggattttcccattaggcaagagactagtaaagatataggtacttgaggaatgcctttgtgtaatataatttgtaaccaagtcagagaaatacatatataactgtgaagagggtcattttctggcatgtggaaatgtttttcttaaaatgggttcaacttcaaatttagtcactgttaacaaattaatagtaacattttcacaggaaatgcagaatttactagttagctggtttttgcttctgagcggtctctgttattgatttcaggttctgcctgaattctcagtggctttccctttgtcctgttgaggacaaattttaagctaccctttgtggtcaggaccctgctaactgtagtttctttgattcccacacaactttgcagttagggtgaacttattcttcacaaacaattcttatccttagggctttgcacagtttttttcttctggaatatgcatctccacagcctccattctccctatacacaaagagaccccttttcacctggccaatttctaatcctaagcctccccctaatataggttgggcctccttttatttaccctcacactgccctgtggtacacagcacattccattccttatgtgtcacagagcatcagcatcacctgagggactaagaaatgtaactcctaggctctgcttcagaaattgatgcattttatctgggctagaatcaagcatatttagaaaaccaagaacaacttgggtgattccaatgcactgtgagcatggagaaccactgtgttgttgtgatcacctgttttctatgcagccctcagggaagtgcaaacctgtgagatcaggcaccattatctgtcttggactttgtattcccagttcctagcccagtgcctggtatgcagagggagctcatattttttgaaagaatgtgtgaagagacctgcctctgggagtcaggaatgtgacaattgggaaatccagcaacaatacctgcttttccagtacctttctcctaaaagttactggatcctacagatcttagtgggcgtatacttggtgttagaagaatagaaatctttctaattcccttccttttccccattttgcaattgtgggttggctgaagaaaagaagacaacatgggaaaggaaaatctgggtgataaacggattaaacctttaggttaccgctgctctagataaacccatgatgtgactttttgtttttctcctaggtcagctgagggaacagctcagttaccttaagggtgataatttttttaggtttacttgttcggattgctcagcagatggcaaggagcagtatgaaaggctgaagctgacatggcagcaagtgagtaaaaagcccttccccaaatccatgagggtggttcccccaggagtttgttggaacgaatatctagaaacttagggatgagcttttgagttgtttggaggggcactttttatttcgcaatgaaattagataccgaatatgtggagaagggagtgaaaaatactcgctgtaatcccagcactctgggaggccaaggcgggcagatcacctgaggtcaggacttcgagaccagcctggccaacatggtgaaaccccatttccattgaaaatacaaaaattagctggctatggtggtgggcccctgtaatcccaactacctgggagactgaggcaggagaatcgcttgaacctgggaggcggaggctgcagtgagcccacaccgtgccactgtactccagcttgggcgacaaagtgtgactccttttcaaaaaaaaaaaaatatattcactgctgacttggtgaattgggcttgagaggcttgagaatctcatgatttcttttatatgtgataccaagctctgattataattgaaaatgaaattctcattttcctggcagccattttaagaacaataaaactatttttttaaagtggaaagatggctatgttgaaaatagatttggaagaaggaaggtgactgattgcaaaaaccaacataacccagcttttctgcatttgaactcggagatgtttgaatttttgtttgctgaaatacttgttcctttttaactgtctctaatatcagcaccctaatctaagtcagctgtatcctaaacaatagctttttgctgatctccaggttgtattaaattgttttagttttgtttctatgtcaatatgttaatgtataatatgaataataaggcatcagtgtatactttttagttcaaaaaccagatgaaaccagacatggtggctcacatctgtaatcccagcactttgggaggcggaggcggccagatcacctgagctcaggagacaagcctgggcaacgtggtgaaaccccgactctataaaaaacaggccaggcgcggtggctcatgcctgtaatcccagcactttgggaggctgagggaggcagatcacctgaggtcgggagttcgagaccagcctgaccaacatggagaaacaccgtctctactaaaaatacaaaattagctgggtgcggtggcacatgcctgtaatcccagctacttgggaggctgaggcaggagaattgcttgaacccaggaggcggaggttgcagtgagccgagatcgcgccactgcactacagcctaggcaacaagagtgaaagtccatctcaaaaaaaaccaaaaaaacaaaacaatacaaaaattagctgaatgtggtggtggtgcactcctgtggtcccagcttctcaggagactgatgtgggagggttgcttgagcctgggaggttgaggctgcaatgagctgtgatcgagccactgtactccagcctgggtggtgacagagtgagaccccatctcaaaaaaaaaaaaattatatattacttagtttttatgttcattcattcattcaacagatactgagtacctgttatgaaccaggtgctgttctaggcctgagactactgtggtgaacgagacagctaaggcctctgccccaagacagctgacattctatacttaattttgataataaacagatcaacaagataattacccacagcactttttactttgaaggaaatagagtaatgagaaagattttaaattacaccattttagccacttatggtgttccttgtaaattgtagttgccttagcagccttcgtctattatcttaattatcagtgctttattaggacagctgatgaaatctgtcagtgttgaattaggaagccttttctttgacttgcctgaaaaaaatgtaagtagaaaatgaagagaagtttgtattgaggatagagccttatgaatattataactgggacatttttctcaagtgtacatgggatactgtgtgtaggcaagatcttattaatagattattgtgatatgtgcacacaggtagatttgtatttgtcctgcaagttgtttctcataaaagctgtaaaatggaagaagagcaaatatatgtaaattttcaaaaatgtgagttttctgtagtggttctttttaaaagaaaagctggcttttgcttattttgctcagagtatgtaatattggctcactttgcatatttatttattctttttaaaaaaaaattttaaatctttttgaggcacagtctcactctgttgctcaggctggagtgcagtggcacaatctcggctcactgcaacctccgcctcccaggttcaagcaatcctcctgcctcagcccctctagtagctgggattacaggcatgtgccaccatgcctggctaattttttgtatttttagtagagatggggttttgccatgttggccaggctggtctcgaactcctgacctcaggtgatccacccacctcggcatcccaaagtgctgggattacaggcgtgagccaccgtgcccggccactttgcatatttaattagactaacataacttgcagattattttttcacttccaaaatacgtattgatggtggatactaacctggtagggtgaagtgataacttaggttgcacatatgtggttcttagcaaacaactgaccagtatttctagttgcatctgaaaaagcccatctctcactgaagacctgaaagagaatcagttggtcttgaatggactccattgatgtagccacattcttagtatattgaaatgtgggttttccgtctttaaattttaaactttgaaagatttaccaaagaaatatgtagaaatgcttgtaacacaaatagcattttgtttgtattataaaatacttacagtaaagaggtctgatctcctgattaaaaagccccttcttgccacactccctttctgtgtcctctcctcttccttggtgactcctgtgaatagcagttccatacgtaggagaaactttatcaaacatttgggaaggatagggaagtttttgcattcttttcctggagactcattcttatggcacaagtaaagatactatgatcgatctttgcttgttatttttctagtgttcttcagcatatactgagtacctgccagctctgagctaggccctgtggatacattggtccacaagatcagcctcattactgatgagcttggtctggtaacatgagagcagaaaactaaactggggttcatttttttttgtttttttttttttgagatggagtttcactcttgttgcccaggctggagtgcaatggcgcgatcttggctcactgcaacctctgcctcctgcattcaaacgattctcctgcttcagcctcccgagtagctggaactacaggcgtgcgccaccatgcctggctaatttttgtatttttagtagagacggggtttcaccatgttggccaggctggtcttgaactcctgacctcacgtgattcacccacctcagcctcccaaagtgctgggattacaggcgtgagccaccatgcccggcctgggattcattcttttagatcataaattccaggagagaaggaaaaacaggtcctttatatattagtttatagtttgcctagtaaagattaagtgataatagaaaaagttattttcaagtaaatatgtaagctttttagggtcataaaatgtctcaattatacaaaaaagtcatagaaatactttatcactgagattatcagcaaatacatatttctgagatactcttctgagagtgggcaaagctcgttctatgattttcttaaattatttattgagcaataattattttttaaaattgtgatgaaatatgcataacatatagtttaccattttttagtgtacagtgcagtggaattaagtacattcacattgctgtgtaatcaccaccaccatccacctccagaatttttttatctttacaaaatgaaactccgtgcccattaaacactaacttcccatgaatattgattgtttaaaggaaggtgtttgttggctgatgtagaccagatgcagatataactggaagacattttttaaaatctgttcatggggttaattgtttttagactgtctgcaagtattgcaagtttaagaatgggggaaattgaaacttggttagtgaagggtcagaattactgggcccctttgagtggtgtagatattgctctttccgtaagactgctggggatttaatgctgtgaatacagatgttgggggcattaactgcaatttactacactccttacagctacaggatgctctttatagaaataaggattaggctgggcgcagtggctcacatctgtaatcccagcacttttggaggctgaggcgggcaggtcacttgaggtcaggagtttgaaaccctgtctctactgaaaatacaaaaattagccaggagtggtggtgcgcatctgagatcccagctacttgggaggctgaggcaggaaaattgcttgaacccaggaatcagaggttgcagtgagccgagatcgcaccatcacattccagcttgggcatcacagtgggactcttgtctcaaaaaaaccaaacaaacaaatacaaaaaaacatctatatgagtatctgagtatagatgcaaagaaaaatgtctgaaaggatgggattatttcttgatggtggatttcaagtgatttttacttccttcccatttggggccatgaattcctcatctgtaaaataagagtagattagattaggagtttgcatcctgagctctggggttgtcttggagcgctctgaaaatgggctgagtggctaggcctttcagttccctgtttcttctctaatgctgatttcatttgaaggaggggtttgacaggtaaaaatggctaagtcaccgagtagatagatggcatgtagcattatttttagttctgaaattctgagtcttgtttttgccatctaagagcttagagaaatatatacaagggtaattttcaagatatttgataaagggtagtgccgttggtcagaaaatgctggctggagtaggcacctggaggcctcctgctggccagaaggtaccccttgatttaggactacactgtgtagggtgcgggatccttgggacaatgcctgtttatcagctgattcaggggcatctctgttgtagccatcagttcagccacacattagccctgcatgtgtggcacctaaggattagatgcttagttctgcacataattaagtggattagtgataatctaacgaaagtaaaaaaggaagtaaattctaccctgggaatattccaagataccgtccgtcctttgttcgctctgttccccaccattcctactcagaatataaaacagaagaagcttttcccccctcaagattaacatccctaaccgtgctgttctcccacctcttgtttcaattgtgtttcaggtcgtcatgttggcaatgtacaacttgtctctggaaggaagtggacgtcaaggttatttcaggtggaaagaagatatctgtgcttttattgagaaacattggacttttttactagggaataggtaatgtgtttttaaaaaatcttatacttcaaggaatatgtaaagaatgaagtatacaggatttgagacagcctaatgtagacttgttagagatttattttaatttttttgagatagagtctcccaggctggagtgcagtggcatgaccatagctcactgcatcctcaacctcctgggctcaagtagtcctcctgcatcagcctcctgagtagctgggattacaggtgtgcaccaacatgcctggcttatttatttatttatttattttttggaggcagagtcttgctctctcccccaggctagagtgcagtggcgtgatctcggcacactgcaaccgccacctcccgggttcaagcgattctcctgccttagcctcctgagtagctgggattacaggcacctgccactatgcccagctaatttttgtatttttagtagagacggggtttcaccatgttggccaggctggtcttgaactcctgaccacaagtgatctgtctgcctcggcttcccaaagtgcttggattacaggcgtgagccactgcgcctggccttatatttttgtagagacaggggtctcgtgttgtctcaggctggttttgaactcctgggctcaaacagctctcctgccttagccttccaaagtgctgggattatggtgggtgtgaatcaccgttccttaccttgttagagatttagagtgtttacttgtggcaattacgaaaatttttgaattccagagaatatttttacttttttaagattaaaaaaaaaacttggctgggcgcagtggctcatgcctgtaatcccagcactttgggaggccgaggtgggtggatcacctgaggtcaggagttcaagaccagcctcgccaacatggtgaaaccccatctctactaaaatacaaaaattagctgggcgtggtggcaggcaactataatcccagctactgaggaggctgaggcaggagaattgcttgaacccaggaggtggaggttgcagtgagccaagattgcgccattgcactccagcctgggcaacagagtgagactccatctcaaaaaaaaaaaaaaaaagatgtttgtttcaactgaacatgacgttttttgaagaaattcttagaatgttaaaaaataagagttgtattacatgagactgttcaagagttggataagtcaatatttcacttgaggagatagggttattatattcttttaagctgtgtgtggtggggcatgcctgttgtcccagctactcaggagaccaaggttggaggatcactcgagcccaggagtttgaagccagcctggacagtatagtgagacccccatctcttagaaaacaccaaccaggctgggcccggtagctcaggcctgtaatcccagcattttgggaggccgaggcgagcagatcacctgaggtctggagttcgagaccagcctggccaacatggtgaaaccccatctctactaaaaatacagaaattagctgggcttggtggcgggtgcccgtaatcccagctactcgggaggctgaagcaggagaatcgcttgaacctgggaggcggaggttacagtgagctgagatggggccacttcactccagcctgggtgactcagcgagactccatctcaaacaaacaaacaaccaaccaaaaaaagaaccaaaacagagcagtgccttctaggaggacaagacaggaaaaataatggcagttactgactgcatctatttaggttgcccttagttaatagagttttgtattactagtatttgtttttaactctgtaaagtagacactcttttttatttttaactatttttcatagtgcttagcaaagtctgggcacatctgcatgtggcttgttcattggtcactgtgtttatcattgcgctttgagtttgctgctgtgtgctctccccagtggctgctttggtgcattagactcggggatgccgatgcacagaccttgcgaccatatattttcactaaatgtccacgtggatctatcaagacttttattgctcttgggtacttgtgagtttgctaccacactggtgaatttttgtttgagattctgattgttagttgctgtctgaagtcctgtgtgagattcatgaatcttacataatgaggttagtttagacatgacaaagtctttgatcacttcaggtcagggcagggagttcatgcctttcctcacttggggttcactgcagcctctgtttcttcagaagctgaggaatcacagctttgctcatgttactgagagtacgggagggtagtcagaaggagggtgacctgcaggctgctgtgagaaaatggaatagactccctacatttttgcaaaaggggttattttagttcttgagctatttattggtgctaagaaaagaatcgacactataactggttctttctcataaggaaaagaaatctgttgtttagtttaatgatttagcactatttatggaccttaatgtaccccatttataagggataagaaagggaaaaaactgataaaattggatcttggaatgttttcatgatcttcgagtgctgtcctatttagtgggttatctcctggaaaaaattagatttagattgcctgtttttaaaaatattgctggattttaacagaagttgtttaaatgcttcatttgttcatttctagagcatgttctgagaggaatcagctgagccttatttctttttaacatgccaatgaaaggcattaattactctccagtttctgtgtagtttatttagtgtgttggccatattggtatatcaccggaattattatttatttgatcttcctatttaaatcaagtcacctgaaaaatacattaattttaaaaagaaacttaacatcaccatggtaagtgggaaacctatataaattgtcataagtagaatgtaacaataaaaataaaacaatgctgttaaattgtagctggatcccatggcatataatggcaagccatggctttcttttccagtcaaaaagggaggctgctacaagtgttaatgagaatttaaagcagtaaactttcttttgatctaaccagaagaagcaaaagagaattagaaatcactttatgattcttgccacccggtttcatgctacagtgctgctcttcactttgggaactccacttgaaatatcagtgattggagaagtcccctgaaaccactacccctgggtagttaccacttgctcagacatttctgtgtatgaatgttaacaagattaccgtaccccagagaagctgtctgtaaagagcatttatatttaaggtacacttttttcatagctactaaagattttcattctgctatccataggacgtactttatttatttacttacttacttatttttttgagacggagtcctgctctgtcgtccaggctggagtgcagcggcgtgatctcggctcactgcaacctccgcctcccaggttcaagcaattctccggtctcagcctccggagtagctgctactgcattaagaactaaaattgaccagtattaaccgcagtctactgtctatgccttcccttggaaaccacaagcctttattagactccagagtcccaaaatagttccatcagtcagattctgccagtgcaactgctgtccaggcaggaaggcaaatgcttcctatctgccaccttcccagaatcctcgtaaagttgattgaagtgtagatactatgaatgtgtactatcatatttcatcaattctaagatccattaactttaagatacaccattttgtgtacaaataagagctaactaccaattaaattatgacatatcagtaactataagatgtatctagctgtcagagatgtcaaaatttgcaaaattacgtatcttaaaatcagtaaaatatggtagtagaagaaaatattcaagctattcttcactaatcaaaactataccttctggaagaattcaaggccaggactgtaaaagcagattaaatgaacaaatactaggcaattattcagtaataactaagttttcatatactttttaacttgtttctacaatggtacataaaattatttaggttagcacaccccaccatgcacgactaatttttgtatttttcgtagggacagggtttcaccttattggtcaggctggtcttgaactcctgacctcaggtgatccacccgcctggcctcccaaaatgctgagattataggcgtgaaccactgcacctggccaggacatactttaaattcttaaaaattgtaaccatttctcatttgtcacaagatctaagagaatgctatacagtgtaatgaagttctgaattttctttcagatgtttacaggtttttcttttatgcctttaatatgttattaaagtttaaatgtaaaaaggtgggggtttttttggtgctacccatcccccttctccagccactaggaagaaagctgtgtgtgtgttcctggagtggcttacacacagcttgtagcatccagggtgggcaaaaataagcctgttttccaaatactgggtatttgtgctctgatcactgattgctgcttctaatcatagaggtgaaaagagatggcagccattgttgttatagctcccctcattgcaaaaatgggtaaaggcatttaatagacacttcttcaaagatattaaaatggccaataagcacatcaaaagatgctcagcatcactaatcattagggaaatgcaaatcaaatctataacacgataccacctcatgcctcttaggatgacaattatcaaagaaacaaaacaacaactgtgggcgagaatgtggagaaatgggaacccttttgcagtgttggtgggaatgtaaaattgtacaatcgttgtggaaaatggtgtggtgtttcctcaaatagttaaaaatataatgatcatatgatctggcaatttcacttctgggtatatactcaaaaggactgaaagcagggtctcagagatacttgtatatccatgtttttagcagcattattcacaataactgagatgtggaagcaaccaaagtgtccatcagtagatgaatggataagcaaaatgtggcatatacatacagtggatatcattcagtcttaaaaaggaaggacattctggcacatgctgcagtgtagatgaaccttgaggacattatgctgtgtgaaacaaaccaatcacaagaaaacaaacactgtgtgattccacttatctgagatacttagggtagtgaaaatcacagatacagaacgtagaatggtggttgtcagcacttggcggggagggtggaattgggagttgtttaacggatatagagtttcggttttgccctgtgaaaagtgttctgaaagtggatggtggtggtgattgtaccatataaatgtacttaataccactgaactatactgttaaaaattgttcagatagtaaatgttatgtatattttaccacaataataattttgggggaaaactattgaggccattcataaatactgtgtttgtatatgtcctggcaacaaatttattccattccatacaaatgtctcattatgtgttgtgctgtgatttagctggctatattagtttgctaatgatgctgtaacacaaactggatggcttaaacaacagaaatgtattctagttctagaggctggaaatctgaaatccaggtgttgataggattggttccttttgaaggctgtgagggagagagtattttatgcctctcccctagcttctgttagccacaggccttccttggcttgtagatgacgttctccctgtgtcttcatgcatcttccctctctacacgtctgtctctgtgtccaagtttcccctttgtgtaaggacaccagtcatattggattagtgttcaacttaatgacctcatgatcactgtttgcacataaggtcacattcacaagtactgggacttccaacatcttttgggaggatacgatgaaatctgtaacactggccgataattttataaacatttatgttatttccagtttttctgtgtttaagttagccttgtggggcatattcttgtatatatatcctttgtgtttttgtgattagaagtagatttgcgaggtcagaggatacacacaattttgctgtacattatgaaagtaacctccagaaagtatatgcccatttatagtcccactgtcaatgtacaagtacgcacccgttttcgacacagtaaataacacattggtttttaaaatcttttgagtctttgtcagtcttttttattgtttttgtttgtttgagatagggtttcaccctgtcacccaggctggagtgcaatggcacagtaatggctcactgcagccactacctcccaggcacaagtgatcctcccacctcaacctcccaagtagctgggaccacaggcacgtgccatcacacccagctaatttttttatttttatttttttgtaaaaatgaggtctcactatgttgcccagacttctgtttgtttattgcagtaaaaacagtgaaaatttaccatcttaaccagttccaagtgtacagttcagtggtgttaagtatgttcacgtatttgaatatagattcacagatggccagaactcttctcagcttgcagatctgaaactctatccctattaaataactctccattctcccctccccacagctctaggcagtcaccattctactttctgtgtctatgaatttgactactctaaatacttcatatatgtagaaccatacagtatttgtctttttgggactggcttatttcacttagcataagtgtcctcaagggttatccacattgcagtatgtgataggatttcctttatttttaagactgaataatattctattgtatgtgtttatgctacattttgtatttattagagaggatttggaaagattagaaaaagataagaatgtaggagaggtactttggaaccaaaagcttgggggtttcattctctccatctcagatagtgctttttttgagacccagtttcattcttgttgcccgggctggagtgcaatggtgcagtcttggctcactgcagcctccgcctctcgggttcaaagattctcctgcctcaccctcccgagtagctgggattacaggcatgtgccaccacacccagctaattttgtatttttagtagagacggggtttcaccctgtcagccaaactggtctcgaactcctgacctcaggtgatccacccgcctcggcctcccaaagtgctggaattacaggcgtgagccaccgcacccagcctcagatagtgcttatgcctactatagctgagcttatttgttttgtttattttctgagttttctattaatattacgtctctgttcctcagaatggttttcctttgccttcccagcaataccttccaactgttagactggtcttcttgtgaaagactgtcttctaggatttccggggattgatgtatcttttcaaggtggaaatagaacagtcgccttgaaagaatttccgttagggaacccggatagttggcattttgcatgttttgttattttgttgtgcagtaggtgctctctgtgtttgtggagtataccacatagttttgttaccactctagtgcatcgaggcagataggatcagattgagagatgtgtgctactcctcgggtaaaatgaggtatttactggagccagttaacttctatcacaaaatgcccagccttggagttacactttttgtatgctttattcttgggagctgtgcttaattcacataacaaagcaacttaattaaaattagcctgtagaattccataatcgtgatgattgtgatgagaagtatttcacgtgctttgtttgaattattgcatttaatcctcacagcaaccctgtgaggtaagttctattatcctgattttacagatgaacaaaccgaggctgctagaagttggtagcgccagggtttgaagcaggcgaactccagagcctctctcctgcctctcgtgctctgctccttcagtagctggaggtgccattgcatgttgcaggccaggagtcacagtatacacagactgtcttttctgtataatgagcaaaagtgccaatcatttttaaattcttggactctttaggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaaggtactgttgtgagaacagtacaaaagttgctagtcagaccagagccaagcaggtgtgagcccaggagacgctcctgcttccactgggcatggctcgcaggcctctctggagctactctgtttaacacttctgtgatgacacttgtgtgtgtgctagaaataaatgccacataaaaacattttatcacttcctaatcaagctatcagttttataaatttcccagggtatctgaaaggttcaatgttttccatctggtttttgtttttaaacttctcacaaaggtgaagagatattttaaaattcccgtaataaataacatgatgaattcccatgtaccttccacctcactttgacattaactcctgacagtctcattttatctaaatcctcagtacttttccccaaccttccccattcttacaattggattatttagaaacaaatcccaggaatcaacatttcattcctaaatatcttagtatgtatctctaagagatcaggattctttcctttttgcagcctgaccataatgccattttcatatttaaaaagatgttaacagtgacttcttactatcacatattgatctggttttataatctaaaaagcttttaatgagcttttaaatttttatatttatttgtttgcttgtttgtttatttatttgaggtacagtctcgctttgttgcccaggctggagtgcagtggtgcaatctttgctcactgcaacctctgcctcctaggttcaaatgattctcgtgcctcagcctcccaaataacatgccaccatgcccagctaatatttttgtatttttattacagacggggttttgccatgttggccaggctgatctcgaactcctgacctcaggcgatccacctgccttggcctcacaaagtgctgggattacagggtgagccaccggatcaggctgatgagcttttaaaattttaaaaatatgattgggaagaaaatcaaatagtacttaagggtgtaaagtatgaaagttcccccacctgcctatggcctgcaatttcacttcccagagtaaccactgttgtcttttgtgaatactttcagaaagatctctgcagatttaagcattttcttagttttttaaaaaagtaaaatggactcgtactattatgagttttccatttttgccacacttaccagtatgtcttggacatctttccatgacagtacatgtagatttaccctattttatttcattacatccattatataattatgtgataatttgttaaaccattctcctgttgatggacattttggttgtttctacctttttgttgctattttatttatttattttttaattaaaacatttttaaaaagtaatagagatagggtctcgccatgtttcctgggctggtcttgaactgttgggctcaagtgatcctccagcctctccttccaaaagtgctgggattacaggcatgagccatcatgcctgaccttttgttactttaaacagtgctacaattctacaaatttgtgtacatgtgaaaatgtgataaattcctggagtttctacatcaaagggcatattcattcaaaattttaatcaggattgccaaattatcctccaagaaactgtaataaggccgggcatggtggctcatgcctgtaatcccagtactttgggaggccgagacaggtggatcatctgaggtcaggagttcgagaccagcctggccaacatgatgaaaccccatctgtacaaaaatacaaaaatcagccgggcgtgatggcgcatgcctgtaatcccagcttctctggaggctgaggcaggagaattgcttgaacccgggaggcggaggttgcagtgagccgagatcacaccactaacattccagcctgggtgacagagcaagaccctgtctcaaaaaaaaaaaaaagtacccattgaaatgcccatgaaaatgcccatttccccatacatttactgagctttatcaaactttttttttggctcactgcagccaccacctcccaggctcaaaatccacccacctcagcctcccaaagttctgggattaagaggcgtgcaccaccacgcctggctaaacttttaatgtttgccagttccagtaggtgaaagatagtatttatttgtttaaatttgcagtataacttcttttttctcaagagatatctaagtcttttttagtttagggcattcattgaacatttctctttattgaacatgatattactcataataataaattagcaaaagaaactaaagttgagtagttattttaaaatttagatatgggttgagcaatccaaatctgaaaatccaaaatcaaaaacactccaaaatctgaaactttttcagcactgacataacgctcaaaggaaatgctcatttgcagcatttcggattttgtatttctgggtttgggatactcagccaataagtaaaatgcaaatattccaaaagccgaaaacatctgaaatccaaaacatgcttgtgcccaagcatttcagatgagggatactcagcctgtatttattctttcttagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatggtaagagtttgtttgctttgctcttttattttgggtatgggccatggtataaatgtacaagttttcaccccgtgggctgtgtgctctgcatttcttccttcctatgtcttgatgacactgttttgtactctgcacagatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccaggtgaatgcaagcacttgctgtaaagcccttgggggcaggagtggaggtggggcaggcagcactaggcattggacatggttatgctgtgaccttttaaatcctgagtaatttgggaagagaaaagtaaagtgcaagggaaaaaaatacaaaaatcgctgggctttatttttcagaattgttcattgtaagtacacctgaatacatctgagtttttcttttcctttaggcattcaaacataacctataagttttcttcatctgtctctcttgtctctctctctctgaggatagatatgcatggtttgtgtcgtagctttgacaaatttgttgaggccatgacggtgtctctgacactgtgttgcagaggatctgaaggtgtgtagacatctgcgaaggacaacatgaagaaatagcagccaagggatcagtgtggtatcagtgttgctcaaaggatggtcggtggaacccaaattttgtggatgcttctgggaacaattaattccacttagaactacctgtatatactctcccactgggaggaacaagaggccttattccctttatctttgctagcacttgacactaaccagcctttaagttttgctaattggctggctgtaaagtgaaatcttgttttttatttatatttctttggttacaggtgaggttaaatttcctggttgtttctttgtgaattgcctgtttggagtctgcatgtttttctctcttctctggaagctagtgggatctgctcttcattgctggtgttctggtattattcagtgatgtgccgtatgtagggcttatgtctttccttgtgctggacatgtggtgtgtgggccctttcaatttgaaactttctttcctgagtatggaaaagtcttgatttcctatcttctattttttctgttctctcattttagaactccccattatttggatattggaccctgtagattaaaagttggcaaactttatctgtaaagaaataagtatttctgccagatagtaattattttaggctttgccggccacaaaatctcattcggaactcttcaactctgctgttgtgattggagagccgtagtgaatgagtgtggctgtgttccagtaaaactttatctactaaaatgggcagtggactggatttagcctgggggctatagtttaccaagatccctactccagatagatcctcttttcttttttttcctaattcccatctttcctgggaagcacagtattaactggcctgcctaccaggagccaagtcgggagggcccaggagcccatcgtttaggaggtaaactgactctccctgtcttcagtacagtactcccacccttggcttcctgtgtccagaatctccctcttgagcctctccagtcttctgcccgtggagggaaagatcatttcctagatgtgggcagtataattactataggggtataattggagcctttaacctcttaaagagcctcacaatccatagtcataccccccaggctctaagcctgatgccttaggtgactacacttccctgaggctgtgttttgtaaatcaccctgcttagcttcaccactggcttaggtattggctttctttggtctgttaagtcatttgctgcttgttcatatgcttttgttagtcatctattcacttgttcttgttctttttttttttttttttgagacatggtctctctctgtcacgcaggttggaatgtagtggcacaaccacagctcattgcagccccgaactctcaggctcaagcaattctcccacctcagcttcccaagtagctggtactataggcacacactaccacactcagctaattttttttttaatttttatttttagtagagacagggtcctactatcttgcccagactgatctcaaactcctgggctcgagtgatcgcctcagcctcccaaagtgctgggattacaggcatgagccattgcgcctggccaatattcacctgttctttgttcttattcttgtgggcctgtctgtttactgcctatacttaattttttaaattgtaagatgtgtcatacagatagaaggcagcatagaaatatggtataatttagatattagtaaaataaatgcccatgtattcatctcctggataaagagtgttgtaaacaccttagaagtctcctgtgtactttctgttcccctcagaggaagccactttgacttacagtgttaattattcttttgctttttaaatgtgtatgtctctaaatgatatacttttcgtttaaaaaaatactgagtagcaagcataaatctagctgtgtaagtaaattgccactattagatgaagtttcctggagaagataagctaaatagtcattctgggtcattgttgtggactgaattgtgtcccccttaagcatatgttgaagtcccaaccctggtacctatgaatgcagccttatctggaaataggccctttgcaaatataattagccaagaccaccaaggattgccggcagcaccaggagctaagagaagggcacagaacaaattctcccctagtgcgtaccccagagagcatagccctgcccacactgtgacttctgacatttggcctctagaactgtgagacaataaattcctgttgttttaagccacccagtttgtggtgctttgttcctacagccctgggaaactaatacttacagtgatgttctggcttcggcttccatgaaccccttctgaggtagtcactggccaaggtcactagggagtcctgggaaacatgaggctcaccatagcgtatgcatcagccagggctgtgatgtataccagagatgcggcagaaatctgggcagaggaagtgggatcctctgtatttcctgcctgagctgacagcttccttccagcttgcagaaggtcaaagcagttatttgtggagtgagcatcatcagctggtctttggggtgggcatgggtggtgtacaggaggctcacctgtacatggtgaagacaagctgagcgtagataagattctgggccacgacgccataggtttaaaagatggtcagtggcagcaaggacttaaggatgatagcctcaatatgtgttagaaataccaaaattgttagaaatagataatcggtgctgcgaagaaaagtcagcacagagacaaaaggtatctcagcaaggccatcttttctttctgtagaaagggtgctcagttgcagatggaacaaaggtgagagcacacttgaacacaggaaaagcagacatatttatcccttacgcacttgggtcgtccttactgctgtgtcctgcatccactggctggagcgggacctcacaatcttaaactgatacccgatttgctaatagcctaaaactttcctaaataggtaagtgcagggaagaacaaagaagttgcttacaaaaggtttaaggaagcaataacatttccaaataaggaaggggcgtagactgtgggctggaacgtgcctgtgagcatgtccaacggttacagaggatagggcttaacaaagagttattagcacaaggcaaggagacttgaagaaagttagtctttaaaagaaactgttatttctaacacttatgatttattctttaacaagaaggaaaactttgaagaggaaactttttactttctacactatgtctgccccttgggtcacacttgttcaccctttgttgtgaaactcagcaggggtgttgggatctcccctctctggagattcttttgccctcctctgtatttgatctcctgtttcctgtggcccatctttaccttgttataggtttattcccttgttcttaatgacttcctgagaaaagctgcatgggaagtaaaatttgagaccaacatactgaaaagaccctcattaagtgaggttgaacctggaattccatacacagccacattgtctaggtgagacctctgttgaggaccactgcacttcctttaggttttttctttgaatctagtcagagtccctggggaataatcttctgggctcaggatgctggttgccaagttggggaagagggaccttagcattcagcttgtcaggtactcacacctcagccctccagctggatcccctgttagttctctagagatcagacctcctggcttctgggggagggcagccacccagcaacagggagtggaaggatctggggatcatactgctttccacatggtgtttgcctgctccttattttattgtcccatttggtcccagttccagaggaatctgctggctgctgcctggattttagcgggttctgtagtatagattgggttagttctcatttagcttacccaaagccactttgggattttggtgttaaatcagttactatttgtccatctgtttaccagttactgttctaattaagtcagcttctatagttttagtgggattttgggaagtagtaaagctttatatgcttgtgttttaacccagtcttaacttggaattttagtataaattttaatgtatttacacagggagtggctgtaaatgcatttattcaatccatactcttgttttatatttattctttgaatgtattcgtagctataagtttctcaataagtgctgctttagctgtgattcttgacttttgaaatgatgtgattttatttccaatcagtacttggcattttgttatttttctcattatttcctctttaatccaaaggttatttagttgttttttggttttcagatatatgagaattttaagctatgttttggtaattgatgtgatttctaatgttgtattatgatcagagaaaatagtttatgtgatgttcattctgtaccataaagaaagttatacattctatttttattctttttataggtcctaacttaagatacatttatttttccttattctttttttaatatcatgtggttgtccccccaaacaaaaaagtacattttcatgcacttatctctttttttcttttgtattgcttatttaaatgacataaatctttactaaattattcactcgtcctattgtttctttctagattaatttcttgctggactgctttctctaacagttctttaaaaatatgggctttttgaggttaattttgaaaacttatacgactaagaatatcttcatttcactttttcatttaaatgatagcagtcatataaaattgttattttagttttttccattgatattttgaaattatgacttcattatcatcttacatacagtgtcactcctgagaaccccggtactgataagaaatagaaatttttgactgggctcagtggctcatgcctgtaatcccagcactttgggaggtcgaggcaggcagatcacttgaggccaggaatttgagaccagcctggacaatatggtgaaaccccgtctctactaaaaataaaaaaattagccaggcctggtggcgcatgcctataatcccagctgcttgggaggctgaggcttgagaatcacttgaaccagagaggcagaggttacagtgagctgagatcatgccactgcactccagcgtgggtgattgggtgagactctctctcaaaaaaaaaaaattttttttgtttcttatcaattaagtggcctccttgttttattctcccatctcctaaaactttcagaattttctctttgttttttatctttaattagtgcatgttaagtgtcttttattttctctttttaaagctttgttttcttttttctattattttattttccagcacatccaaaacacagaaattgtgtttgttctcatttgtcttacttgacaactctgttcttttggtcagaggtattttatatgcttcttggcatttattctgcttggtgttcgctgaccttcctgaatgtgtggtttggtgtctgacattaaattggggatattctcagtcattattgcttcaaatttttcttctattcctttctgtcttctggtattcccattgtgtgtttattacaccttttgtagttttccgcagttctcggatagtctgttttgttcttttttttcatcttttttgtctttgcttttcagttttggaagtttttactgacagatcctcaagttcagagattctttactcagccgtgtccagtctacaaataagcccatcatcaaaggcaacctttatattggttacagtgttttttatctccagcatttctttttgattcattttcagagttttcatctctttaattgcccatctgttcttgcatattgtgtattttgtccattaagcccttaacatattaaacatattataggcatatcttgttttattcacattgctgtattgcacttcacagatactgcattttgtacaaatggaaggtttgtgacaatcttatgtcgagcaagtctgttggcaccatttttctagtagtgtgtgcttactttctgtctctgtgtctcacgttttggcagtttttgcattacttccaactttttcattattattatatcttttatggtggtctgtgatcagtgatctttgatgttagtattgtaattgttttggagcaccatgaaccacacccatatgagacaatgaacttaattggtaaatgtgtgttttctgactgttgcactaaccagctgttccccatgtttctccctctccttggggctccctgttccctgagacaacaatattggaattaggtcagttaaccctacaatggcttttaagtgttcaagtaaaaggaagagttatacttctctcactttaaataaaaaactagaaatgattaagtttagtgaggaaagcatttcaaaagcagagataggctgaaagcgaggcctcttgtgccaaacaattagccaaggtgtgaatgcaaaggaaaagttcttgaaggtcattaaaggtgctactccagtgagtgcacaactgataaaaaatcgaagtagccttattgctgatatggagaaagtttgagtggtctggatagaagatcaaaccagccacagtattcccttaagccaaagcctaatccagagtaaggccttaactcttgaattctgtaaaggcttggagaagggaggaagctacagaagaaaagttggaagctatcagaggttggttcatgaggtttaggaaagaaggcagctctataacacaaaagagtgcaagttaaagcagcatttgctaatgtagaagcagcaacacgttatctagaagacctagctaagatcattgatggaagtggctacactaagcaagatgttcactgtagatgaaacagccttctatttgaagaagatgccacctaggactttcatagttagagagaagtcagtgcctagcttcagagcttcaaaggacaagccaactgtcttgttagggattaatgcaactggtgactttcagttggagccagtgatcatttactcttccaaaaatcttagggcccttataaattatcctgaatctaccctggctgtgctctataaatatagcagcaaagcttggatgacagcatatctgtttacagcatggtttactgaatattctaagcccactattgaaagctactactcagagaaaaagattattttcttttttgagacggagtcttgctctgtcgcccaggctggagtgcagtggcgcaatctcggctcactgcaagctccacctcccaggttcatgccattctcctgcctcagcctcctgagtagctgggactacaggcgtccgccaccatgcccagcttattttttgtattttttttagtagagacgggatttcaccgtgttagccaggagggcctcgatctcctgacctcgtggtccgcccgcctcggcctcccaaagtgctgggattacaggcatgagccaccgtgcccggcctgaaaaagattattttcaaacaattactgctcattgacaatgtacctggtcacccaagagttctgattgagaggtttaagattagtattattttcatgcctgctaaaacaacatctattctgtaacccatggatcaaggagtaattttgactttcaagtcttaccatttaagactctttttaaggctattgctatcatagatagtgattcctctgatagatctgggcaaagacattgaaaaccttctggaaaaggagtcatcattctagatgccattaagaacatttgtgattcatgggaggaatcaaaatttcaacatttacaggagtttggaagaagttgattccaagcctcatggatgacttttgaggggttcaagacttcagtggaagaagtcactgtggatgtggaaagagcaagagaactagaattagaagtggagcctgaagatgtgaccgataaatgtcatgataaaacttgaatgaataagtgttgcttcttatggatgagcaaagaaagtggttttttgagatgctatctactcctgctaaagatgctatgaacattgttgaaatctcacaacaaaagatttagaatattgcataaacttagttgataagttagtggcacagtttgactcagattttgaaagaagttatgttgtgggtgaaatgctgtcaaacagcatcacatggccaggcacagtggctcacgcctgtaatcccagcactttgggaggccgaggcgggcggatcacgtgaggtcaggagtttgagaccagcctggccaacatagtgaaaccctgtctttactgaaaatacaaaaattagccaggcgtggtggtgtacacctgtagtcccagctacttgggaggctgaggcaggagaatcgcttgaacctgggaggtggaggtctcagttagctgagatcatacccctgcactgtagcctaggcaacagggcaagactctgtctcaaaaaaaccaatatcttttgtgaaaggaagagcaggtcaatgtggcatgcttcagtgttgtcttattttaagaaattgccccagccatcccaaccttcagcagccaccaccaccctgatcagttggcaaccatcaatattgaggcaagagcctctaccaataaaatgattgactcactgaaggctcagatgatcattggcattttttaacaataaagtgtttaaaattaagtcacacatttttttcttagacataatgctgttattgcacacaacaacaatatagtgtcaacttttttttttttatttgagacagagtctcactctgtcacccaggctggagtgcagtggtgcgatctcggcttactgcagcctccacctcctgggttcaagcgattcttctgcctcagcctcccgagtagctgggactaaaggtgcgtgccaccacgcccagctaatttttgtatttttagtagagatgggatttcaccatattggccaggctggtcttgaactcctgacctcgtgatccgcccgcctcggcctcccaaagtgctggaattacaggtttgagccactacgcctggccactttttttttttttttgagacagtgtctcgctgtcacccaggctggagtgtagtggcacaatcatggctcactgtagctgtcagttgacttcctgggctcatgcagtcctcccacttcagcctcccaatgtgctggtattacaggcatgagccaccacacccagccttaaacataatttttatatgcactgggacaccaaaaacttgtgcagcttgctttattatgacattcactttattgcagtggtctggcactgatcctgcaatgtctctgaggtgtgcctatattttaaattcccagtccagtagctgtaacatctttgccatatctcagtctggttctgatgtttgttctgtgtcttcaagctgtgtttttttgcctttataccttgtaattttttgttgaaagccaaagatgatgttctgggtaagaggagctgtgataagtaggctgttggaaatgggggaggtgtgggcagggaaagccctctatagctctgtgagtagttctcagtcttttttgagcctgtgctctgggctgtggactaaaagtgcttctcagttttctctccggtcagctgggacaggatggctagagggtgtgaagttaggtatttctcttcccccaggtgagttaggctctgattaaatcccaataggttaggctctgataaaaataacttctcctgagggcaggtgttactaagaacacaatgctgtgttttattttaagatggttccttttcccctcctccatctggaatcaagaggggagttttctttgatattcactgtgagaacctggtccaacttctggaggtgaaccttgtggagtggagtttttatccttagacttgtccgcattgagccttcagcaattttcagttcttcagggctttcccgccttgatgctggttcccacagaggctctgctcccgtgtgctgtgattctctttctctccaaatttgagggcagtggtttgccttgttatctcatgtcttttacggatctacaagagttcttgatttttcactttgttcagtggtttacttgttaggctggaggaatgacttctaagcttcttgcctgccagagtggaaatcagaagtccttggatatgctgctgtgatctaggaaattccccattattgcttctttaaatatgttcctcctttatcttttcctcttctgcactctgaatatggatgttaacaccattacttcttttttttttttttgtcttttcttttgctttttaaacaaaatccttaaccagtccctgacatcatttgttgagtgctttatttcagtgatcatgtgtttaatatctggtaatgaataagagatgcttcataattactcattcctgcttccaggctcctccattaccttggaggctatttcttatgctttttcttccttaacagctttattaacatacagttcatataccttacaattcacctatttaaagtgtacagttgacgggttcctaatatattcacaaagttgaaccataatcaattttagaacattttgttaacccacaaagaatccctgaaccctttagctgttactacccaaaactccctattcctactgcccatgaattgactttctgcctctgtagatttatgtactctggacatttcacataaatggagtcatataatatgtggcctttggtgaacactttctttcacttagcataatgttttcaagattcatccatattgtaacatatattagtattcctaaatatggcttaatattccattgtatggatagaccacatttggtttatccattcatcagttgatggacttttgggttgtttctaccttttgactatgaacataaatactgctttgaacatatgtatacaagtttttgtgtggacacacatttttatttctctgagtgtagatctaggagtggaattgctttgtcaaatgtaactctgtgtttaactttttgaaggattgctagactgtcttccaaagtggctgtgccgttttacattcccaccaagcagggtatgaagattctgatttctccacacatccttgccatattgttgttgtctgtcttttttattatagccatcctactgagtatgaagtgtagtatctcattgcagttttgatttgcatttctttgatgactattatactttaaaattcttgtctgtttggtaaattaagtgtgccttttcctgtaatagcttgtttagtttgttatccttttgttttcttgcttttttttttatttttttttttgaggtggatttttactgttgtcgcccaggctggagtatagtgatgcgatctcggctcactgcaacctctgcctcctgggttcaagcagttctcctgcctcagccaccgaagtagctgggattacaggtgcccgccaccacacccagctaatttttgtatttttattagagatgtgggtttcatcatgttggccaggctggtctcgaactcctgacctcaggtgatccacccacctcggcctcccagagtgttgggattacaggcatgagccaccgcgcccggcgattttcttgcactttttatttatgggtcttgattttttttttccccgtgagctcatacccccttagtgttttcagctacctttgctggcagtttacacctagggaagagagcaaaagcctggttcctagcttttgaccctgtcagcaagtttagcaaaatgggaggttctgggcaaaaccatttctcctcctctctttttcccacaatcagccaccctcttctctcagggaacctcccaggacctctcgcccaggtgctgcttttaatctccctctggtgttgcttcctaggactgtgggatgctcaggggctgcccagagtggtatccaccctcacccaggaaggctctagtgctgctctggcgttaccttccagccaatacgtggctggcaaagttgattggcagcgatctacctctcccagagaagtgctcgggggaggagatggcttaaccaagcagcccctgacccatctgtggggcagagcctttttctgccctctctactctgctgcctcactcgtacccagccacctgtcgcctccccgggctttctcccagccttgtgttttgccttccctctcatgtctgtagcatctctcagatgggcttggaaagggaccaagcagccctcctagctctccattgtgtttagaattagaagtataaagaaactcatttaacattttttctcacttatttgaccttgggatgcttttttttcccacactttaccattcagcaaatgcaagtcaagtacataacatacaccgagagccgaaacatggctcaaacctgtaatcccagcactttgggaggccaaggcaggcagatcacttgagctcaggagtttgagaccagcctgggcaacatgaggaaacctcgtctctaccaaaaaaaatacaaaaattagccaggtgtggtgacatgtgctacttaggaggctgaggtgagaggatcacttgagctaggaggtcaaggctgtagtgagccatgatcatgccactgcactccagcgtgggcaactgagtgagactgtctcaaaaaaaaaaaaaaaaagccaggtatggtggctcacccctgtaatccccacactttgggaggctgaggtgggcagatcatgatgtcaggagttcaagaccagcctggccaacataatgaaaccccgtctctactaaaaatacaaaaattagccaggcatgctggcgcgtgcctgtagtcccactactcaggaggctgaggcaggagaatcgcttgaatctgggaggtggaggttgcagtgagccgagatgacacctctgcattccagcttgggcaacagagtgagacttcgtctcaaaaaaaaaaaaaaaaaaagtgccaagcgctattctagcaggggatctgctgtgaactaagacagagtaggtccctgtccttaggcagggggcatccttgagcagggagctgacattaactagctcaccaggcaaataagattacatcatgcagagtgaacgcggggacagtgatgttacatcatgcagagtgaacgtggggaggagtagcgggcaggagcactgctctatgggggttcaggacggcctctctgaggaggcagcacttgaactaagtccacaaggaggagccagggtgatgaagggtcagtgtggaaggcccaggcgcaggccctgaagcaggagttgggttggtgtatgtggctggaacctggtgatggcagagggaacgggttggtggctaatgaggctactggggtgacaggggccagatcctgcaggatcctacaggtcataagtaaggagtttgaactgcattctgaacatatggtaggaagccatgtcagagttttgatcaagggaagtgaatttatgtttttagaagactctggcttctgtgtcgagagtggatagtatgggtgtaagagtgggagcagagagaccaatgggaggcagttgatccaggcagcattgggagtggtttacactagagtgggaagaagttagggagctgtataactttgatggagcttcccagaacttaccttgaggcattaaccagataatgagagtattctgtgcagtaagtagttcagtgcctggtgttacagttatctgttgctgcattataaaccactccaaaacttagtggcttttgatccctgtatcttttttctgattctgtggattgactgggcactgttgggttctttacttagtgggctgaaggctgggttcactcatgtgctgcattaacctgagagctagtttgggattggaatgaccaggagagcctctcttcctccagagtccatctccctgtggcctctagttattaactggtctagctggactccaagagggagaaagtggaagcaagccaccagttgtcttaagacctagactcaaaagtcccagaaagttatttctgctactttctgattggtcagagctattcacaaggtccacccagcttcagtgggtggggaaatttatcctgccttttgatacgaggagccgcttagtagggatggaggaattgttagtggctgtatttagaaattacataccacacttttcagttttaccttgaaactgactttaagccttggaagaattcaaagttggcctttgaaaattttggtgtccagtttgggaaggtatgaaagcaaattataatggaaggaatcttgctctttccttttaacaaagttattttctaggttaagagcaaactgattctacaaaaacaagtttttaaacatcatccaacccttcgcaaacaactttataaatgtgccttttaatcttccatctgatttctttgctataaagccctaattgtacatgttctgttagtacatgactgagagccctggagcggcagtcattgaagaacaacatatttccagtccagctcttggggtttgaaatgaaacacataaaatctaccaagtctgttaggataccttcctagggaacagaggcctcttcctcattgaacccctgataagacctctctgctactgagatttattttagggaggctgaggcaggagaatcacttgaacctgggaggcagaggttgtagtgagccaagatcgcaccactgcactccagcctggataacagagcaagactctatctcaaaaaaaaaacaaaaaacaaaagtgacttgggtgctattgaaagcattccattttaaaagggaaacagaacataaaagttcagaaaagttgcagcctgacaatgcagtagacaaaaaaaacctattttttgaggagaaagtcaagctggctgcagaaatttacataagtaacaaggagccgaatgttaatccccaagacaatctccatggcattccacgggaatccacgggagtgatattctacatcactcccatttttgtcaaatttattcactggaaaagagattgtattagtttgttttcatgctgctgataaagacatacctgagattgggaagaaaaagaggtttaattggacttagagtcccacctggctagggagacctcagaatcatggtgggaggcaaaagccactcttacatggtggtggcaagagaaaaatgagaaagatgcaaaagtggaaacccctgataaaaccatcagatctcgtgagacttattcactaccatgagaacagtatggtggaaaccgcccccgtgattcaaattatctcccactgggtctctcccacaccatgtgggaattatgggaatacaattcaagatgagatttgagtggagacacagagccaaaccatatcattccacccctggcctctccaaatctcatgccctcacactaaaaaaccaatcatgccttcccaacagtcccccaaagtcttaactcatttcagcattaacccgaaagtccatagtcccaagtctcatctgagacaaggcaagtcccttccatctgtgagcctgtaaaatcaaaagcaagctagttacttcctagatacagtgagggtacaggtattgggtaaatacagcagttctacatgggagaaataggccaaaacaaaggggttacagggcccatgcaagcttgaattccagcagggcaaattctaaatgatctaaaatgatctcctttgactccttatcttacatccaggtcacactgatgcaaaaggtaggttctcagagtcttaggcagctccacccctgtggctttgcagggtatagcccccctcctggctgctttcatgggctggcattgagtgtccaacttttccagttgcacagtgcaggctatcggtggatctgccattctggggtctgaaggacggtggccctcttctcacagctaggcactgccccagtagggactctgtgtgggggctctgaccccacatttcccctctgcactgccctagcagagattatccatgagggccctgccctgacagcaaacttttgcctgggcatccaggtgtttccatacatcttctgaaatctaggtggaggttcccaaacctcaattctggacttctgtgcaccctcaggctcaatgcaaagtggaagctgccaaggtttggggcttgcaccctgtgaaaccatgggccgagctgtaccttggccccttttagcaatgactggagcggctggggcacagggcggcaagtccccaggctgccttctaggcttccaggtctgtgatgggaggggctgccatgaatacctatggcatgccgtggagattgtcttggggattaacattcggctccttgttacttatgtaaatttctgcagccagcttgactttctcctcaaaaaataggtttttcttttctactgcattgtcaggctgcaacttttctgaacttttatgttctgtttcccttttaaaatggaatgcttttaatagcacccaagtcacttttgttttttgtttttttttgagatagagtcttgctctgttgtccaggctggagtgcagtggtgcgatcttggctcactacaacctctacctcccaggttcaagtgattctcctgcctcagcctcccaagtagctgggattacaggtgtgtgccactatgcctggctaatttttgcatttttagtagagacagggtttcaccatgttggccaggctggtcttgaactcctaacctcaggtgatctgcccacctccgtctcccatagtgctaggattacaggcatgagccaccatgcctggccttcaagtcacctcttgaatgctctgctgcttagaaatttcttccaccagataccctaaatcatctcaaattcagagttccacagatctctagggcagggcaaaatgccagcagtctctttgctaaaacatagtaagagtcacctttgctccaattcccaacaaattcctcatctccatctgagaccacctcagcctggaccttattgttcatatcactatcagcatttttgtcaaagccattcaacaaatctctaggaagttccaaactttcccacattttcctgtcttcttatgagccctccaaactgtttcagcctctgcctaatacccagttccaaagtcatttccacattttcagatatcttttcagcaacaccccactcctggtaccaatttattatattagtctgtcttcatgctgctgataaagacatacccaagactgggaagaaaaggaggtttaattggacttacagttccacatggctgggtaggcctcagaatcatggcaggaggtgaaagacacttcttagtgggcagtggcaagaaacaaatgaggaagatgcaaaagcagaaacccctgattaaaaaaaacaaaacatcggaccttgtgagacttattcactacgagaacagtatggtggaaaccgcccccatgattcaaattatctcccaccaggtccctcccacaacacaaaggaattaagggagtacaattcaagatgaggtttgtctgggaacacagagccaaaccatatcagagatgtatttcaaaaattctatatacagtagtagttggccccagtggctctttggataacagagcaatcatataatatgactcatgtgtgtgttacctacttgatactagttaatatttagtgaatgggttgaaggcataatatagacaaagtgaagcctagagaagctgcaaatccagtgttcaatcctgcatctcactccctctaatgagttaaaaaaaatttttaaatgacttcagaattttaaaattattatttttattttaaacagctggggttttttgtgtctagttttatgcaaaggtgtctataaactttgtattgaagtttgagctttccaaataagtaatacaaaaagacctactttatgacacataaaaatatgatactaattatatatggaaattaaccaatcctcagagtaattttgtttcttttttttttttttttttttttgagacggagtctcgctctatcgcccaggctggagtgcagtggtgcaatctcggctcactgcaagctccgcctcctgggttcacgccattctcctgcctcagcctcccaagtagctgggactacaggcgcacctgccaccacggccggctaatttttgtatttttagtagagacagggttttaccgtgttagccaggatgatctcgatcttgtgaccttgtgatccgcctacctcagcttcccaaagtgttgggattaccggcatgagccactgtgcccagcctgagtaattatttctatataaccagtgtttctttctcatagacttccttgccgtccaggaagggatttcgacaccagaccaccaagtttttgtatcgcttggtaggatcagaagatatggctgtggaccagagtattgtcagcccttatacctctcggatcttgaaaccttatatcaggtatatggagaactagaggtgtgatgtcaggtgtgtcatgagggataatgattgtggtttctgtgccctgttctcctgttggagagaataaagatcacaaactgtgaacaacattggcaaggactgagttctgtgcttcacctccagttttgtcctttgcttgtttcaactctacttttttgcagagaacatggtcctttgaaagaaacttaaaaagcaaaaataaattaactgaaagattgctttgtgatgatcataatcattgttttatttattattattattttttttttgagacagactcttgccctgtcacccaggctgggctgcagtggtgcaatcttggctcactgtaacctctgcctccggggttcagggaattatcttgcctcagcctcccaagtagctgggattataggcatgcaccaccaagcccagctaatttttgtatttttagcagagacagggtttcaccgtgttggccaagctggtcttgaactcctgacctcaagtgatccacccagcttggcctcccaaagtgctgggattacaggcgtgagccactggggccggccctcattatgttattttaaatactaaagttgtatatttttagtagtctgaaatgaaaaaatgtgaaagacatctcagttgagcctccatctggactggatgtatatgaagcagtttccaataatgaatgtcattgtccaggcaatgaaatggaagctgagcttgctagagaggacccagcagtgtctggcactgtaaatgagagcacattattgcactcattgcactacaattgccctgcagctccatgatcaccctgaccctccatgccagcaccacattcctgggcaggcacagtgagaagcagtttgtgagcctgctccaagctcattgtgtctctggtgttccccaaatgccccgcaaagttgagtgttccctcttctggcctccaaggcactggagatgcatcctcatgtctgactccttggggtgaatctgatgctgtatctgtttcctcactgttcatgaaggcacctagcacagtccctggtgggtacagagggctttggcctgatgaatgttcagagtgaattttagatttcatacataaaagtatagctgtaatcaagccagcttcgtgtaaaacagtgcaggttactttaaagtttcaagcagatcaaagagtttatatgagtcaaaaagctaggaataataccaggtatttttcttgacttgaatttgtttatcttctgtggtaccggaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggtatgttccccctcccaaaccaggcaggtcatttttctgtacagtccattctagcaatttttaaaattagtttatgtgatatccttaagatttttatttatgatttcgtttagtttgtctctgctaacatggaaatattaaaatacaaatacctcttgctttcccaaaatctagaagaagccagcaataaacagtgtttttgtttgtttctcttccctgtttgtctctgtttccagagtaaaagattcatcctgttttgcttctgcatatgtttagataccaggtaatgtctatcaaagatacacagactggtagcttgggcgtgtttggacacttttgtttttggcttaataattctttatgttttgtttatttagctgttccttagagagtattagtacagccagaaggtgttttttaaaagccaaatgccctgatcacagactgagaataagggtaaacccaatataatttgtcattttatcagccttaacaaaattgcctctgaagaccaaagtcattaattaaaggaacacatttgcattgctaaatataaactattctttgtggatctgctttcccacgctgccttgaaacctaaaggaaataatacatgtctttcagatgttagatacgatttcatcaagatagagctgtgtcgtctttattgtcacataatcacataactgtgaatgtggtggcagagctgcactcattcttttgggagtcatactgagccaaaagtaacattctgggagcatctcctgcttcctgcccttatgttaggtgccttccatacattatgcacagaagcatattttacttatttattgtgaaaggtagcatttgtacaaaagaacttataaattatatgtgtggggggtaaaggatgtgatagaacacgctcggaggatctttacttaaccctgtcaggtctaggtatgctcttcatcttacatattgcagaaacggagtctctgagacattttgaaatgtgccaagccacacatggtagaggaggctgagttcaaagccagctgtgtccaattctgaacccgtgcactgctacctaccctattctgccactcttcttttaggaaatactatgtaatttcaatattttctaaaattcactcttatttttatgatctggttgtgtggtctctatgttacctccagttttggtgttttttttttttttttttagcatgcaggtgtagctatatgtacatgctgaacagcttggtgttccttaattctcaaaggcatgtggtttgagtctccgatggtttcttttctttaggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcaggtaagttgtctatgtttatgatttatcacctgtgtctgggctcccctgaacaacctggaggaggaatgaagctgagctagcccttcccagcatggcccaatggaatggtttccttgtaaaccaagtgaagaaagccagtcatcagcattcatgaggttatcaaagcacacagtcaaaaatcttcgaccctctaaaataagattattattcagactcaggtttcatagaaaccagtttgtgaacatgtgtataaataaaatgagaaaataccaaaagcaagagctttagggtggactattcatattagtagtagctactgctcttaggatcatcaccttcgcaactcagagaagtgagggtaggactattatttttatttttttaaatatttgtaaacattttagcacaactgtatcaataagaatatgtatatattttttgagacagggtctcattctgtcacccagactggagttgcacaatcatagctcactgcagcctcaacctcctgggctcgagtgattttcccgcctcagccttctgggtagccaggaccacaggtgcacactgccatgcccggctgattttttgtagggacagggtctcactgtgttgcctggtctgtgcttgaactccttggttcaagcaatccttccacctcagcctcccgagtgctgggattatgggcatgagccactgtgcctagctacatattttatttttgctgatagtttgtaattttactatcactgtataaggctgatatgaaccttctaagatttgattctagtattgaattataattcatcctttaatatatttgtatcacctttgaagaaaatacaccatatatcaccatcaaaaaacatgcaaggatttttttcccctagaattttttttagtcaacttttacttagaaaccatttggtatggaggattatatgtttatgcaggcaagattccttttaaagaggagatgaagatgataaaagttgtttctccaatttttaatgaaacttgcttaataattcccaaatgttggcaggaaccttggaaccattttcctagaaattgctttccttctctccttaggcagtgattatgtaaatcactcactgagtaattaatatgtgctactttgggtggtggttttctcttgagagcttctcagttatttctacaacactccctttctctgccccatcccaaccaagagttgatctctcagtatgcgtctttttaacctaggagagcacttagaggatttgctgccgtatctgtcactggtaagggcctgaagacagggcacgaatagtactctgtccttgtgtgtgtgtgtccttggtgcccaacatgagggctggtacagagtcagtccctgctgagtgtttgcgaggccactggaggagtggttcatctttgcaggtgggcaccttcccctccagccagaccatacccctgagggcccaaacataggtggcgcacagtcgctggcactcaatgatggccacggtgagatcacgtatatttgcaatctagcaaacaccaatatgaccccacaaaatttgctttaaaaactcacaaagtgctcttgtccctggcatactggtaagtgctctcttgtcctaaaaatgcctatggatacacatggaagttaagcagagaaagcaggtagctatcagatgactgtcaacagaggagttcttagaggcctgagagaaccatgggttataaatctcaaggactctatcaacttcagtatttcagtgccttctttattaaaaagtaagttcttaaatgatatgacttttgggacaccttactctgtgtagctgattaaagaatctaaggacttgccttgtgttgatagaatgattgttactcttttcccctaagattaggtcaaagctgaatgtagaaatctcagttctaagaagctaattctgtcagttttagagagacagaaggtggactttgggattcagaaggtctatacaagggcctcaggttttataattacattcttaatatttcatgtttgtgcatgtaatttagcaggcctagtaaaggaatttttacaggttttggggaggtacaagataacatctagttttaaaaagcaaaacttattttgttttgtatttattcaaggttatcatagtgttaggtattgaaatgtttgacatatttaaaggtaattgagttgtaaataataaagctgacaataacaatatccccattgaccctttgcttcaaagaaaaataaaaaacacccagaatactatcagtttccttggtcttgtgaatgttttgatcagcagcaaaatgtcattctgtttccagctgttgctaggtgttgcaatgtctcagcctcagtctctgatttctccggtttccataactaactgcctacacttaaaagcgtttctttacctactcattttccctcaggcctttccatttttatcttgtatttttccactcttttggcagacctgcatgggcaaggacgtaacccttcacgtctcagcaagcaaccctgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaa

SEQ ID NO: 9099 - DNA, 6053 bp, Homo sapiens
cagtgtttttcttcacaggttttgcacactagggaccaagaagccctcggggacactgctgagaaaagactgccgaagggaagaccagcgggtaaggccttcttgactgctcacctggtctgtgaccaagggaacctaggtggggagcccatgatttgtgttaacatgcaagggaaacagaggtacatgtgtgatgggtagagatgtatttaattttaaaagagcaaaagtgtgtggtatatagcgatttactgttttttttttttttatttctgaagattgataattcaagtgttttcttaaaggttttcccacttcaaaatgaaatatgaaaaaactcattccagacacttaagaatagtttaatgaggctacttttgaattgtttaataataattcaaagatttaaaaacttatatggatgaaggctgtatgtataacttttaacatcccaggactgaagtcatttttccccaaagtaaagaatacttgctggtttttaaatgctatatggatagtgcttttctgaagatttccttctgtaatataaacaacaggaataatagtacctaacaataaaagaagaacctgccaagtcttgcctaccagacaatgcagatgggatttgcccagagaagagcaccgacccacaacttattgagtcagcaactgagtaaatcagggaataaaaacctctatctttagatacccctgtaaatatctgttttacattttttttaaatcaaagagtggttaataattgctgctcagctgagccctcttgcctatagcttacaatgcttccacttctctgagcatttaaaataaggcactttgtctagaaacccactgataaaaaaggaatttgtaaacgaaggcagaagttttctttggtcagtttccagctgtcctggaggtgaaagagggtgggagagggggaggaaggtgggagggaagaaaaccctcaagctgaatgaaatcctaatagagaaaataatagagcaagtctggattgcaatgtgatctgtgctgaactttagaggtcggccccttaaagaaagttctggaaaaatgttattgcctcatccctaattttcttaacccccattaatttctattccgaaacaattctatataatgaaaacatctcttctacagggtttgtgaaaaataaacataatctcttttgtcctcctttaaagttacagtggttcctgaacaaattcttttctaagttatacattttgcaacaattcaaaaattgactcaagttctctttagcaaaatattttattataaaagattccctaagttttcttttgtcaaaacaacttactttaaaaattacccttctgatcaccccaaaatgtgtataaagaaaacattaagtattctcatatattcatgattattagttaaaatataaacagcaaggagaaatttagctactttcacttagatgatatagtaaagttatcctttcattttctattgtgacttggagagttccatattaattatttttagtagaacaaatgagatgttaaaaatctatatagtttcttttacataagaaaactaaaaaaagtaacttagaggagctcattttttcaagaaatatattttttctaattgatacaattactgaagaggaaaaatagctaacaaggtactttggtaatgtttttctcaaattttctgggttttttttttttttttactctagaaatgattacatttcaaaatttgctttcatttaatgtatatttaatttcaatttctttcttcatgttaaacggtctttttgtttcaaagaaatgaatccctatgggtccctcacctattttctccctcaggatgacttttagtctggagatagaagggacataagggtgcctctggcataagtacaggagtagaaatataagaattactttgtaaaaggataaccaaggagttcctgcacatgcttgatgtggctctagcgacttattttcgaggcaaagttttaacaaatgaaaacgaatagtacttatttttcaattatatgggctaaattaaagatcaaaggtaaaagctcattttataaagctctgctgaatgaaggcaggattgtagtttatgcgctggtacacacgcccacatttatatacattatagccatatctatatccaggtaaattagaaaaatgtttaattttattttcatattactttataaggagatatacaaatattttagggatcatggaatctattccagaggaaactaaccaacagtgagcatcttcaactaaaactacccctggatgtaataagtgtaagtattaaaattaaacattatatgtggtcatgaagagaaaattgtttcagggtctgtccaaactacacttcatagaaatttcataattatttttcattttagcatgtgaatgattgataaattggactaggtactgggttaaaaggacttttccaccatctaagagaaaggaagttcagagccttagcttcaacaccacaatttcttaactggaaaaggatcaatctaaaacggtggacttaaattttcaaactcatttttcttttaggccacagatctcaaaatcaaagaaagactgtttactataggacaaagtttcacactgatcactttcctgtagttagtcaataggcttaatatccttcctgcttggcattcgggctttcggcccagataatatgtttatgtttgtaaaagaccaaaatatactatctacccccacctctcgcctacagaccacccatgtatttcactctgtgggaaacagtttaggcataaaaatcctaacgaaagaattctccccacttttttggttgaagtcttaagctgttataagatataaaaagtacaacttggtaatgtgaaaaaattcactcatccacaagcatccatgctcggtaaagagacgccaaagctttcacttactctgtaagggatctgctctttataaacaatgcactttactctgctctaaggagaatagcccacccatcacaataacgtcaaaataataactaagagaccatcactcagaaatcctggcttaaaataactagaaggtcaggctttaacctgagacaggaaattcctgagttaagatagaaactttcttacttcaaatcccttcttactttcatgttctgtaaattaagtagaaataaatatttactcattttcaaaggtctcttacaaataatttttatcagttttaatagttagagataacgaagtaaattaggaaaaataattaaatcttcattttgaattttttgacttagcgtgacagccagtttcctggagttgctttggtttaatttcactacagaagacttagaagacaattcttttcttacatttttttccttaagaaataaaagacaaaaagaaaacaaggtgtaataaccacactaaaaattacatggtatgataataatacaaatagctcttttatgttttagctagtattttaagtaataataaactaatattcaacctataatttgggagattaaaaaaaggtcaatatggttttcagtctttcatctttttaacaagtttaggggcaggttcaacataacaatgaagtgtgcatatgtcacatagttactgtaagtgtgttttaaaaatctatcagaaacataaattgtccaaaagccttatgaatagaacaattgttttcagcaagattttttttttcccctgaaaaactgttgtggtttttctggctcaaaaaatttttatatcttgccttaataaaactgttttatattaaagcataacatacaaactcacaaatatttctttttattttttcaggttgcatgcatcattcctttaattgagcagagttaactggatcaaattatttatgggagagagaggaaaagttataaagaattatagtaatttttaatttccaccaatatactctttgtaagtgaatcactctataattactttctgttgcactgaatgcagcaacaataacacaatagtattttaaggcactggtttttggcatactctaaccttgtaattatttaaataacagccaagtttactcatgtttttgattctgtcaagaaaaaaaaaaagttcctttactcgaaagtgatggccgaaacagaatcggaaatttgttttcttgaaattacataaatacacagaaaatggcacttattagcttttgttaaaacattaccttacctaatcactgcataaaagtccagatttgtagaaaattgtaattttctcagtatctaaaactattttgctttccattaagtttctatttgctattttctcagaattttacaattaaagataaatcacaaactgtttgtttttcttaaagttctttgagaaaatgtctaattatacaatccttggacaatactgtgtttttttggtgctgtgttttttaagaagtcctacttactggaattttgactatttggatatttttgtttttaaaaggggaggggaatttgcttaatacttctaaagatgtgaattgataattgatattaaaatagaattactctcaactcaccagaattaaattttatatctgcatatttaacactattagctcatataaattataagaaaaattttcaaaggatctggttttaattttttggatatgaaatgaatttgccttttctgccttttcttaagtactattttgtaactatattgcactaactatatccaaaacacattctgagcatcactgtgagtaacagccttccagtttgtacccttttgattcacagcatggccctatagttaattaagaggtggataacttaagctcacaactgcctttaatttgatttcacatccacagttataaactttgcatttaaaaggaaaatgagacatttaaataggttcctgttgtttcacatataattggtaaaaacatattcccttgtaggatcctattatcagagcatcaaataccaaagtcagcaacttgggttgccaaataaattaggctcattaattattttgaaaagggctgctgtttccatgtaaatgataattttctttttcatggacaaggttatggtacttatctactaaaagaaacatgcataaacatagtttttatctttaacttcagtattaaaatatgcagttttttgcaaagaggaaaaacatctggttcaattacgctgaactctgactacatgtgggccagtaataatatgaattggacttaagaataaaccttgtgtttaatctctttttttccttaaaattttaatgtgagttttctgttacgcaaattatccatgttagcacatttggaacaaatgtataaatgtactttctgaataaagtcaaaagtctaacttgtttttagttccataatgttttaatgtttaattatattgtgtatttttctccctttccccttactctccaaaatcaccaaatctggaaaacaggctgattgtatctgtctatgagcaaaggaaacctgaaggaaccaagggcctggctggacagagttgtcatgtgtctgcctgtctacacttgctgtgcagaacatccgctcacctgtacagcaggcacagacaggcagtcacatgacaacccagcctgaatgacaaccagccattgaaagaaagcagccctcacaccatagcatctacaccaagagctacaaccaaaatgaggggctcgggggcctggggttttaatctgttggtttaatacttaactcatgtattattttattttgattcaagtattaaaacccaccaaaagtaaagtgagtggtgcctatgaaatataataaaacccatttctgaaaatgttcctgtgcattctatagttctcttttcctaattgttgtcagcaaatcactacccttgacctttattgtacacagctttgcagcaccctatattgatataaaaactcaatataacaaaacaatataacttcagtctgatgcttaacaaagaataaattattctaagaattcttgtccata

SEQ ID NO: 9100 - DNA, 1402 bp, Homo sapiens
ttttttttttttttttggaaggggatagggtggaaagacagagaaaagaaaagggagaaaaagagtattccaaaggatcaagtgctttgagttaactctgccagtctgggttaactctgccagtctgggtctgggcaaaacacagtgaaaagactactatttccaactagtgttcaactatattaaaataatagtttctcctcttttgacatatggaaagttgaaatttttgatacttccacgcgtcatggtatacataaatttatgactgcgtcattctttaattaagaaggtgcttatgctacagttctaggagtagaatttacaaggccaacacattcacttgcaacctatgcttccatcactataaactttcaagatcttgagatgttcaggcaattcatttatcttcagaagcataaggaaagtggttaatgcacttgaaatgtatattttgacacatcttttgagaaaatatccaaacttcagtttatgcactgttaactggagtgaaatgataagggatggcttttgtctatgaatactttaaatacttaagggtaaaaggtgggaagatggataaaattagaaatgtgtcaacttttatttagttcattaacatgttttagcttcagtatttgaaattaattttcatctttcttagattctggtcaagcttaaaaaatgtaacacaaggctactcaaaacttttttcacatttaacaattaaacactttatgtatgtattcttaactaaagcaaactatttttcattcagctattttatttttaaaatgaaagtctcagtcttaaagctaagatcccagtgagtttcaaattttctgacaatgatattttaaccaaacctgacattatagtttctttaattaaaaaactgaatgatggggcaaaactacaaagcacaaatatgattaaagttaaatttctctcatttaaacaatcttgtcttatggcaatatgtcatctgctaaaattcatctctgcttctgcaagatacattgcacgatgcagatttttgccttaaataaaagtcccattactagcaaataaagtcctaaacaatacttacaaaatgtagaatataaacaggaagacaatataaaaattactcacagaatatcgacatcgttctacccaatcttaaatgccttgtaccacctgttgcaaatgctgcctatgagagttcacgtatggaattattctactggaccctgcaaggctcaggagagtgcttgacagctcccagaatgagacaatgacctagccagaacattaaggagactacacccgtccttcagactccaaagggaaagctaggacggcagcagagtcatcctaaggtgaggcactccaggataacattttcaatatttttccttaa

SEQ ID NO: 9101 - DNA, 1070 bp, Homo sapiens
cttttattgagaaaaggggaagtaggatttagtctactgcgtatttccctgctctctacagataccttatcgctcccgtgaagtgctggcttcatgcattcctatcacaaggcaatcactcagggtaaacgatgatgctgcatgtcttttgtgccacctctacatttctctaaaccatattaaaattgaaaccaaaagcacagataaaagcaatgaaaatatgaattcacttttccatgtgctggtctcacctagtgcttctacttaaatttttaatttatgggaaatatacttcaatctataatttttttgtaattttgaaatgagcgatatgaatttttattgcattattgaatggcccttgtttacctatcctttataccttatttataaagtgcatcctttataaaggatgaagtgtatatagtgcataaaagatatactttataaaatatatcctttatgcactatatgcctccatagtatcaggtatatatttcattaggagatgcatacatatttatatactgcaatccaggccattatactgatataggagagaagaggtcatctatgtcagaattgttttcctaacattctctaaatttccctagcttataaattacttccttgcatttcaaaaaagatgcttttggtttttgtagataatatgggtcacaccagttctgctgagccccagttgcatttacttctctaagacctagattatatggtttaccatagtgatatttttcattgactcaaaaatataagagattatttactcctaaatatatcgtaagatgttagcttcaatttagaaaactttatttgcttatatccttattgttccaccttattacttggccaaaactatggaaatcagtcatatctcattcccaagattaaaaattttaggaaacctgactgggcaccgtggctcatgcctgtaattccaccactttgggaggccgaggcaggcagattgcttgaggccaggagtttgagaccagcctggacaacatggtgaaaccctgtgtctacaaaaaataccaaaaaaaaaaaaaaaa

SEQ ID NO: 9102 - DNA, 1716 bp, Homo sapiens
tgattgcctgtctcaccaccagtttctctccttactactgcagctgggtatttaagtagctctttatttaaaaaatggaaatgaacagatatagtctttcttttccctgggcagttgctgactctggattcctctgtggaatattatactcttaagaactatctgtagatgactctccttttgcaaaggcaaagcagaaattaattaaccattaaccaaataatcacattggcatcatccacagaattgtaatattctctggggcacaggatacttcttttttcatccccacgcccattataaataccttttatacatgcatgcagaatgaaaaaggaccatgggcccatgtcagtattttcagcttcacccaacactaaaatagcaactatttccagtcattttttgcatacaaaagacacacatacacagtaaatttggggggagcaggttgttgcttttataaactgcatggtatgtttgagtgcagttactcgattttaaagctcctgagttgtaatgatagcttaactatagctatactttgccagccttttaaatctaaaaccatttttaaaaaaacatttgtttacccatgtgactattcatttactcagtagtcacagagacttcaggctgcaaacatgtgttgaatgtgccccttcacccaaataaattctgtgtctgatgtgttcgatatttgtccatcttattttcatttaaattgaaattttaaaaagatgttcccatccatgtgatagagttgtttgtgtttgtttgtcaccaccgtttcccttccccttggaaaaaaaattgagattagaatatgacatcttataccttttggtggcttccaaaccaggggtgtgatcaaaccaatgttttctgaatgatagatacggcatcagtgattgaaaacagaatctcaattttggcagcttggggctacaaggccttgtcctccctcccaaacatttgaaaacacccatcccagggactctcccaaccatccttcaaagataatggtatctttgaagtgactgtatcatacaagtgattttggctaacacccaccagaggacagtctcctgtactctctccggggtacactaacactgttgatgcttggcagggtggcaagtatacagagtgaacctggtcaacagaacctccttgttcagcagccgctggggaggaagaggggcctgaggcaggtaagtagacccttaaagcgcaagagaaccatcctacgaattggaagctctgtgtgatttttaatgcccatgtatattaagatattttgctgctggacgtgcccggaatcccagctactggggaggctgatgtgggaggattgcttgagcccaggagttagagtccagcctgggcaacatagtaagactctgtctctaaaaaactaactaaataaataaaacaatgttttttttttaaagtttatattttgcattcaccctacctaaaataagcagcacagagcaactttaaaacgtggtaagtacttaggcaagccaaatgtttcgatcttctattttagctctgaattttcttattagcaaagctgattatgtggtaaagtaagtggggctataattctatttgttccttacccagaaactttctttaccagccaaacttattgatagaggaagatttgttatacagttgatttaaggcctgtttctgcataaaggcaaa

SEQ ID NO: 9103 - DNA, 1561 bp, Homo sapiens; identical to SEQ ID NO: 6253

SEQ ID NO: 9104 - DNA, 1561 bp, Homo sapiens; identical to SEQ ID NO: 6254

SEQ ID NO: 9105 - DNA, 1561 bp, Homo sapiens; identical to SEQ ID NO: 6255

SEQ ID NO: 9106 - DNA, 161 bp, Homo sapiens; identical to SEQ ID NO: 6256

SEQ ID NO: 9107 - DNA, 285 bp, Homo sapiens; identical to SEQ ID NO: 6257

SEQ ID NO: 9108 - DNA, 415 bp, Homo sapiens; identical to SEQ ID NO: 6258

SEQ ID NO: 9109 - DNA, 285 bp, Homo sapiens; identical to SEQ ID NO: 6257

SEQ ID NO: 9110 - DNA, 285 bp, Homo sapiens; identical to SEQ ID NO: 6257

SEQ ID NO: 9111 - DNA, 415 bp, Homo sapiens; identical to SEQ ID NO: 6258

SEQ ID NO: 9112 - DNA, 6151 bp, Homo sapiens
tgggagttgagattttaatatcataaatcggtgtggggccacacctctcactgccaggcccgtgggcctcctatcttcatattgcctggaaggctgcctgcagccagggcttcccccatcccctaggaaggatccagcaccagcctgagaagggaggcaacagcagctaaaggggtgggaggaggaggagacagaagcatgtgctgcaggcgcatgtgtgtatgtacttacatgtgtgaacacatataaagtgtcaggtttacagaccctggctcaaggacagtctaggatgggaaaggaggtagggcgagaagaagcacatattttctccctggtgcttcagcctcaccctatccaagggacagacatatggggtgtgagaaacccatccccaggtcccagccttcaggactggagtccttttgagtctggtggagtcacagatccagtctttgggggacactgggtctgtctccttttgaaagccctggaaaggtgggaggtaagaagtaaagggagacaggtccctgctagaagaacttgacgcctcggccatcgctgacagtgatgatctcggccttgtgctcctgctgtagggcctgcagagcccgcagtagagtggcttcatccagcccgtggaactctgaacagggagagataggcagagacaatcagctcctgaggcccaaggcctctgaggagagtgctctggctggaagccgagacctcccagaggcagggtatgcataagccatctatactgctacagctgccatccacacttcccaggcactccttaggagtaaggggtggaagaaagcctgaatcagcatgaaatgagtttgtgcttatttcccccttcttggttctcctctcagactcagcctcccccacacctagcatttgtgtctgatgcacgagaatgacaccatctgcttcagggccacaaaggggccgtgaaaatcaggcctagggagatcggagccattgtcactagacactgaccctagaggatctatcctaacacaaagaatatagccagtacccctggccaggagactgttaaactccagcactattatctgccctttttctagcttttagctgggagcacaggccaggcgcggtggctcacgcctgtaatcccagaactttggaaggctgaggtgggagggtcacttgagatcaggagttctagaccaccctggccaacatggagaaaccctgtctctactaaaattacaaaaaattagctgggcatggtggtggtcacttgtaatcccagctactcaggaggctgaggcagaagaatcacttgaacccgggaggtggaggttgcagtgtcaagatcgtgcaactgcactccagcttgggggacagagcaagactttgtctcaaaaaaaaaaccaaaaaaattggggagcctatggctagctgagtatgtggagatatggtaagatactgcagggagatgtgggaggcagcaggcaagccctgacaggcttgcttacctcaccccctgtgggggctcagctaagtcagggagcttgctttctgaggaaacctacaactttgcccaacctgagtggtgggctaggcaaggctacagtgctgaaatcatggggtgatggtgggagtagcaagcagagacctgcagggcagcagggggaacagccaagagctataaactctgctagggcagccagggcctggcagaaaggggagacaccctctgttatcccagctaagatcgaaacttgtggtgatccagaggatcagaatctggagtcggagaaaaagaactaagagtgtttacgctatgtaaaaatcaaacactatacaaatccttgcctggccagaaaccaaagtatataaatgggctgggggtgttggcctaatctcttcagctgacacccacagatcttgagccctctataagaataaagggtgaaagagagcctgagtcagcaaggaatgagatttcaagcttaatcccctgcccttgtttctcattcggcatctatagcagatgctgaatgaagaaagttatttataattttttttattgttattatttttattttctgagacggagtctcgctctgtcatccagactagagtgcagtggtgcgatcttggcttactgcaacctctgccttcgggttcaagcgatcctcctgctgcagcctcccaagtagctcagattacaagcatgcaccaccatgcccggctaatttttgtatttttagtagagacggggtttcactatgttggccaggctggtctggaactcctgacctcaggtgacccacctgcctcggcctcccaaagtgctgggattacaggcgtgagccactgcacccggcctattgttattttttaagatagcatctcgctctgttgcccaggctggagtgcagtggcgtgatcatagctcactgcagccttgacctcctgggctcaagtgatcctcccacctaagccttctgagtaactgagactactggtgcacagcaccatgcccagctgatttttaaattttttgtagagacaggatctccctgtgttgcccaggctggtctcaaactcctgacctcaagcaatcctcccaccttagcctcccaaagtgctaggattacaggcacgagccactgtgcccagctgaaagtgaaattcttaacttttcatgggtcatagatgcccttggaaatcttgtaatatctaatctatccctagaaaaatgcacatgcatccacaaaaacaaaatttgggattttttgcatgtgaattcaggtggcttatggaatccttggacatgggttaagaacttagaatcgcttgaacataggaggcggaggttgcagtgagcagagactgcgccactgcactccagcctgggatacagtgactctgtctcaaaaaaaaaaaaaaaaaaacaggcggggcacagtggctcacgcctctaatcccagcactttgggaggccaaggcaggcggatcacgaggttaggagtttaagaacaacctggctaacatggtgaaaccccatctctactaaaaatacaaaaaattagccaggcgtggtggcgcacacctgtaatcccagctactcaggaagctgaggcaggagaatcgcttcaacctaggaggcggaggttgcagtgagccgagattgcaacattgcactccagcctgggtgacagagcaagactccatatcggaaaaacaaaacaaaacaaaacaaaaaattaactatgagtgggaagggaaaggcattaccctcatcctctgtgtcttccccattagtcagttcatacagggtaaagacggagttgttctggccactcctggaaacctgtgaatacagaaaatgaggagtgaattagaaccaagaatctcctgggagacagtaaattcatcagctccacccctctgatccaggaatgatacctattcccaaaccaggactcactgtcgcctctgcagagtggcctaaaagccataaaccctacaagtgctatatttatatgtgtacacactcatttggaaccactaaaccacaggtcttcacgtgtctgaggagtgaccttgacctctcattctggttgttttcctgttcaagaatggatggtgtgtatttgttatatttagaatgttgatgcttcttaccctcttctcttccttgggaatgtttgggactggtggtttagggggaagagtattctgtccccacacccacactgattcagaatatctcattcatgttgtggacagtcccataacagtgcagtgggggaggggccccaggttttttcccttcctttccccatttatctcctgtggccagaggctccagccaacaatagcactcagggttcccagttctgcattctccaaatatggcctcacatagcccccggcctcctacaggcaaagaaagggaggttctatgcagccaaagacattgagtcacttaaagaggtttccctagaaggcctacacttcctctttctgccccctccccattttgctcagtctggatctgggaacaccggctatctgctaggccctaatatagttaaccttttccatgggtcactgttgaatacttggcagaataatgatctcacccactgatagatgagtttcccccattcttctggcctccgccacatgatcaggaagctggacttgctcttatccaaccactcgaggttccctgtaaaacagatacttatgaaagcataaccaggcgcgcagtggcttacactttgggaggccaaggcgggaggactgcttgagcccaggagttcgaaactagcctgggcaacatgatgagaccctacagaaaatacaaaaaaattctctctatagaaaatacaaaaaattagccaggtgtgtggtgacacatgcctgaggtctcaactactcaggaggctgagatgggaggatcacttgagcctgggagtcgaggctgcagtgagataggactgagccactgcactccagcctggatgacagagtgagaccttatctccccacccaaaaaaaaagtatcatgaactaaaaagaaacaaagaggcaaaaaaataccaaggtgggacagagtggaagagactcagctttcagaaagaaagattcaatatttattttactattattatctacaaggcactcatccttcttccacttctcttcaggtttagggcacagacagagatttcaattttgtgtacaaagaagaaaggacttgggaattgggctgcctactttacagaagactctggccttcaagccaggagagagaaaaagttattaaagggaaaaagacttatcctaatttgccctcaggaaaacccaactaggaagaaaaataaggaatctggggaactgaacccacctttcttcctcagttcctctaatacaatctggatcgactccacaggaagctttcctggtttaaggttaagggaacggcatacacatgagttgggtaggataaaaattttcagagccagtcccatgttgagaaacacctgccccttcctctcccacacacatatgtgtgcaatttcccaacatgatatgaattggcatttcctggatattcaaaggaggaaggtaaagagaaactcttccaattaaaaggagctttatgtgattgtgccactgcattccagcctgagcaagagaggaagaccctgtctccaaaaaaaaaaaaaaaaaagaaagaaagaagctttagaaaatgaaaggtactgtcattcctcaccctctgtctgttgccttccttcagcctttctccacagatattttagggatgaatcaggcagcaaaaacaaatgacccttacttcctggcaggaggggggcagagaaaataattaaaggtagttacccaagtctgggcctcacacagaaaaggatggaagatacaaatagtcaaaagggtttaggttaaaaaacttggaacttggcttcagggcagaaattctaagaccttaatgacatccgagcagtcatcactgccaagaacaagagggtatggtactgcatttgccaggggaaaatgtcagctacacattttcactctttaagtccagtttgggtgggaatctgcctaccatgggtaaaagggggctggcgcgggggggcgtctgggcatgtgtgaaagcgcagaagtgcatgtgtatgggctgtggaagagcctgagggaggatacgctgtagcttgacgttgttgaagagcgggctctcctgagcttccatcaccgtcatgctggactgtttgtgcaggcggcagaaggacaggaccagcgagcaccaggcggccagctgcttctgccgagtgtccacattcggttgtaacctgccgggtgaagggagtggggcgcagaattagagggcgggaggcagcacttgcccgggacgcatttcaggaagaaagtaagggactgagggtgttggccgacgggtcttttctccccctccccatatgaagcatcagggctgagcccagggtccgggggaggggagggaggcacagcggtgcttcttggggtctgagcctcacgtaaagaagggtgggaagcgatactgccacggccactcgaaactcatcgccatcgtagtagcccaggaaacccggaagct

SEQ ID NO: 9113 - DNA, 104 bp, Homo sapiens
atttttgtatttttagtagagacggggtttcaccatgttggtcaggctggtctcaaactcctgacctcaagtgatccgcccacctcggcctcccaaagtgctgg

SEQ ID NO: 9114 - DNA, 8535 bp, Homo sapiens
cagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctggtgaggactgggcagggccagaggtggtgctggtgagggtggggggattgagaataaccaatgaacggacaaaaaaggccaagtgtggtctgaagatgaagatggggccagctttgtgcagggaaggatcgatgcagcaaagggtcgggggaagacccaggagaccatagacactgcacacacacctgtgtccgcacctctccagtctgcccacctctcccctcattagtacctgctgtaagtgaagaatttaggcagaaggatggaggaggactttgtgagggtgggggtgggtgggtagggacaggaatggaggagctattaggagactatttgaagattctgacttggagcaattggggcctcatcttacactccctctgacctccagggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtgggcccctcacccagcacaaggcccaagggatggctgagcctcctggctgtcaaggttgcaggtctcacggaggccctcctctcctactggtttcctccagggaagatgggggtgggacctgcagcccaggggcagctgaccgcagccgccgacaggcctctgccgctgctgcacctgcacatgctcccacattggctggtattatgcacgcagccacagcctggggtacaagtgtatgagagagcgcctgcattatggtcagcgttcttcacgtttgtgcgcgtgcgcagggtggggttgtcatatgtcctggatagctgtctcctggttggtcaattctgggggtgtggctgctctgtctccctatcctattgggtctctcgccctccaccagagcccttctccaaggggagagggtgagtggagggagggatccaggattaggtgccagggtcctgtgccctacttggtggtcccgcatccttggtcctgagatctgaatcctgtagtactagatgcaaagggaggttggcaccagggaggagcatgggcaggcctggaggcatcactcctgcagggggacagttccattgccccttagtctctgtgaaaagagggggcatggggtagacctccacctgcagccttctgctgacccttcccccgaccctttgctgattcctgggcccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggtgagctgcgggcacccccgcatctctccaggtatggtgcatgggagggcgagggcacagggaggggtcctcttgctcaggcagatcttggtctcatgtccgttttaggcatgccatgtcgaagggggcagtgctgggctcattcccagccagctgctggaggagaagcggaaagcatttgtcaagagggacctggagctgacaccaaactcaggtaggaggtcccccctaccccacacctccaatctgggatccaacagggccctgtctgcctcactcacccatctccctatggccagggaccctatgcggcagcctttcaggaaagaaaaagaagcgaatgatgtatttgaccaccaagaatgcaggtgggtatcagagcgccccctcccttaccctcctctaacatggcatgcctttccctgtccccacccatcacctgtgacgacgtgtgcctggctcagatgctgccagccgtgtccctaggccctgcccgactcccccctgctcccctgttccaagccctcttgccctcagcctccctgagagctccgcccctccctcaccgtgcagcctggtgagcagcgccatctccctgtgtccagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctgtgagtgggagctgggccctgctgagttggggacaaggagcagggctcccctggggccagggctgggcccaccgaatgggcatcttcatgggcaccaggccaggtggtacctttgggtacacgggttggggtgcacgccctctgtgggtggttaggggaacttcaggctcaggaagggtgagggaggtgtccagccaacaggtggcctagcgggctgggctggcgtccactttccttctcttgtttcacttgctaaaagccatgaagaaagtgagtgcccagctgtgcacccgggtgaaacaggctacgagctgcatgtgtgtagccttgtggaagacagggcttcttagtggcagaaacagcgggggtggtggaagctcctggctgccagaggcaggactaagagcactgccctggtctgcttggctcttgctgtgtggctttgggctgtacattgccctttctggacctcagcctctcttctgtgggctctgggctggaccatgattaccagctcatgtctctgtgtgtgccaatggggagagtggggggcaggtgtgtgcaaaggcagcagtgctggcaagatggggagcagactgcacctccaaggctgggaaacgggggcctgggtaggggtgcatatatgtgtctgaggcactgtaacctgcccctgcccatttggtccaacctacccccatccccctagacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggtaccgccactctgctccttcccagcctgcccaatgtcctctctgctgcctcattgctcccccatatagttccagacacctgtcacctgaacacgcccatgtaccccctttgccctcaactactgctagaaacccagcccacctggaacctttctcagccttccagggtccccactcctcctctagtctcctccagtcaccccagccacctgccagctgtttgtcatttgtcccaggactcatgtcccagacccccgggcacccttttctcatccactcccaagtgctcaccccaaccccagttaccctcacagcctttctctggttcctaggacagacatggggatatactccctaccttgccttctccttctgcaggcggtgaaggtgctacgaacggccgagtttgtcccttacgtggtgttcatcgaggccccagacttcgagaccctgcgggccatgaacagggctgcgctggagagtggaatatccaccaagcagctcacggtgagggctctgaggtgtgggggaggggtctgatagctgcctagggtggtgggggacaggcctgagctgacagagagaaggaggtggtgttggggagggacaggggcctgctccagttatcagtgaggcaggacgtggtcccccctgcatagatgtggaaggggaggtctgagagaggaagtccaaagtctcagagtgagccaggcacacacctagcctgggatacatgtgcttctgactcaaggcccccggctcagcccactctgcagagacagagtgctggccagagagagttcccgagggcaactgggagaggtgggctggaggtgggccaggtgagcttgggttgcttacagctgggggaaagctgaagggtaggagaaagccagaggcgggaaggctggctggagggctgagtcagcgtcagggagcaggcagcgcctggaggagaggcttcaaggcctcattgcagaactccagccccatcctccttcctatgtcttgctgcgccttcccaggaggtggagggtttgcggcgctctgagcgcaggggtccctctgctggccatgcctggtgctgcagcattccggccccaggtcagagcgtgcctggggcccaggagaggctgtctaggctggcccccttctgccaatgacccccttaaggagctctggacctttgcctgatccccattctgggcacctcctccttggcaacaggtgtggccaactggagctgttgggatgcagctagcttcagcttatttaagtcagttgtcaagtacccttcctcacccctgcccatccagcttccactgggtcgagggtggggttgccctgggtacttgtggattgccctggtaccagcctgtctagctgcataggtaaggcagcctagtcagacttgagggagcactggcttgagagtcaggcagaccctgtttagccactgactggctatgtgacctttttataccttcattttctctgctataaatgggaaagaattaatcctatcttgcagagctgtagtgaagattatgtggcatgcaaagcatttaggggtgtgattggcagttattaaagcttatttcctccctttcactcaccatctgtggttgatggtgagccactttgaggcacgcagagaggggcccctgcctccctagccagggagtccacaccagggttgggctttggggagggggagtgggggcagctgtagctccttctgacagtgggggtgagttgtgggcactgactgtagggaggtccccttgtgcctgggcaggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggcttctggctctgcttttctttggttggggttggatggatggctttgggagagagtgagagctggggagcacagcacagatgactactagaatggaagtcagagcaacatgtcttgttttctgcgatgtcttcctttcctctgtcttgcccctgcacactcccccatccccagaagatgctccttctaagtgcttgtacccaaggacatgaacagacatttctcaaaagaagacatacaagtgacaatgtatgaaaaagtgctttacgtcactaatcatcagagaaatgcaaaccaaaactaccatgagttaccatctcacaccagtcagaatggctattaaaaggtcaaaaaataagagatgctggtgaagttgcagacaagagggagtgcttatacactattggtgggaacgtacattagttcagcccccgtggaaagctgtttggggagttctcatagaactaccattcattccagcaatcccatcactgggcatctacccaaaggagaagaaatcgttccaccaaaaagatacctgcacttgtgtgactgtcactatgggactgaatgaaggaggatgtacgccacttgtgacagttactacaggaccgaacaaaagaggacaaatgcagaaatgaaaacaagacaaaagaatctgctttaaagaaggggtccttgcttttgcttctagtgagcaagggccctgagcttccacagccctccatatttattgggtagaaagagcagggaggagcaggtaacctttggtcagctgcttgatttatcacaggttcacataattgctgacaggcttcatgtgtgcctgtagataatcacaaa

SEQ ID NO: 9115 - DNA, 901 bp, Homo sapiens
gaagacattttagtctttgaggttcatcccattctgttttaattttttcgagacaaaaaatgaccaatctcttatttgcgtattcaagcattcttaataagtcactaaaactcttatttttcataactctccttttattaaaaaccttggggaagagaacaaaacattccacattgaccttagtgagttgttcctaggtaggcatgatgaaaatgcaaaactgaaccccaaatctagccaactgaaagacattgatttttctagaacagcaccttccaaacaccagtctgtggaccagtcactgcttgcccaagacaaagttctcaccagcgtgaggtaaaatgaggaaaataacagcaatgtgtctaaattcattcaacctaaagacttcctttcattctttattgttgtccttcctatttctttgattatttgaacatctttacttctataaaaggaagttgccagcagatggtagttgttctctttaaacgtttctacttagtgaagttaacatttaacacacacctatgttggtcctcccacacccactttatttttttctcatccgtgaaaactagatatctagaaactactgctaggctaagggatagcttctgctatccaagacccccagattttccaaggttcctggccttggagcctttatattttataaaggaaatattttttaatcacattcacatctttaacttttgttttgaacatgtgaaatacaaccttttctggataactctatcatgatcaataatcaatggcattggattagaatacagtgaatctgctggagggcaaatatcatagggcagttttccagaaccagaatcgcccccgggccaccattcttttagcaattcgtttctgtctccttaaaaaaaaa

SEQ ID NO: 9116 - DNA, 1518 bp, Homo sapiens
gagagaaagacagagagagagagaggagtactggcccataaaggtacctaaaagactaaagagtgcatttctgggatctgttaatggaaattgctttcccagcttgaaaattgccacatttaaaatcccaatgtggggtaagcaaaatcataaatatgaactccttttcagacagcaaaccagcatttggagtctctctccttgccttcagggatccatatgccacagtctagttagctgcccagcgactgacaagcataaataaaaggtaacggttatagtaatcagagctgctgtgagtcaaaagtgtttcccagggagggatcaacatgcttctgataacactagagtcaccaaatagccaaggttcagctcttttaaaaacaaacaaataatgaaaacaatgaaaataaaaatgtttgctctgtcaactgtctacattcagcagtggaatggaacaggcacctgggattcataatagtaaaagggtcaggccatggggagcagtctgggtttgatggcttctttgccttccatcagtgctccttgccacctaccattggggacatcctccttcatcgtattactgcctcatgatggtctgtgaacccatctcacctaagttaagtaaacactgggcctcaacttaaggtgataccatcatcagagtaatccttaggagaaagtagataaatagaagatgaggcatgttatgtcctgaaagatggtcaactccttgtctaaagaactaggttaggtgttgaaggatgaggtggcaaactcagccaacaaaattgttccagcctgtggctcatgcaccaatgggcccagcacataaacccttataagtcacacttgaacagggtctcagagggcaagtgaggagttgtccatagagaaatttagatggactcccttggcccttgcagatggccctggatatgttatatgtacatgttgtcattgatgtggccagaaactcctgccttgggatttgccgaatactaacttgacttattggagcaggtgtctgtggtcctccaaagctgtcaactgttaagcatggtgattccaactaaaagtttcatgatcctcactgcctttctcttttaagcctaaacagcagtcatgtaaatgaagtaagattgttctgaaagcctcaggaaaatgactcaaccatggccttctgatgaatctgttttcctctgtcctgaaatgtctgaagtgtttaattacaccttaatctgactctgtcctcttctacttctcaggttttcctgaaatttgcctaattatttctttatgtgacttgattaatagaatgccaatcatgttgtttttatatctctctttctatgtctactgtgatgtgagaaacactcagaggaatgggtgagccaggtgccttcccctgctccctactttgccaagttgataactcctttgacccttgaacattaaccatgagcaccgatgcccgtctttcattcaggctgtattaaagtccactttgcaaag

SEQ ID NO: 9117 - DNA, 390 bp, Homo sapiens
cttttttgttagtctgtaaaatcatttccaggtaaaatctagagcttaatccatatgttgtgccatcttttgcttttccacacctctgatcctaggtaagttagagctaacgagtatttgctgagcttctattatgggctcagcatatgttataatttcttttacacataggaatctgaggcttagagaagtttactgatttacctaatggcacaccataagtgctggggctaagatttaaactcaggtctcctgacttaattcagatggtcagctcgatggtaatcataataatattgttgttgttgttgttgttgttatttatcaacaatagtagtagctaagtcatttcatgaaacagctcattgatagtccatttgataattctga

SEQ ID NO: 9118 - DNA, 3040 bp, Homo sapiens
cagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctggtcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattcttctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatattttttttaaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgagggcctagtatgtagaatttgaaagtagttcaaatttgaattagaagaatgaagctaggacttatttggaaaaggagatagaaaaaaaatgatcagaaactgtggggccttattacctttgcagtaagttatcttctcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgcctgaggagcaaaatgtggttttaatgttgtggaaagatcacttgcaagtatataagactgtataaagaagaggactgtgtgcaagtggggtgaaaaaaaaggatacgtgaatgtgcatatgactgaatagggaggaaggtcagggctagaaaggaggctacataaaaaggggcaatggagaatgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaagaaaggggaagttcctcttggaaaagatatagcaaccatcggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaagtatgctgaaacagaacagtgaatgttttgcccaaaactacaaaaataaaagaaaaaaagaaaattgcaatacatggctactaagtctttgatcataagtcgaatttatagacctggaatttgccatcctagtctttcctttttagtaagacttctgtcctctggcagtgcatatggtaggtctctaatgtttcttcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccctagatccagttttccccatttataacatttcacttagtccattttcggaaccagaaaattaacattggcataatgctattaactaaactacagaccttttttcaatttcgccagtttttccacacatattcatttagttgctggatacttttaattcttgctgatttgtaaactggccttgcttggatacaacaggaaagatactatctggataaagt

SEQ ID NO: 9119 - DNA, 302 bp, Homo sapiens
cttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtg

SEQ ID NO: 9120 - DNA, 2091 bp, Homo sapiens
agcccgggggaacagtcagcgggctctgcgtcccgggagctggggacacgcctgcaaggtgtgtgatcctttaaagatccttagtactagttttgtagggagcctttgttatagctttgtcagcctgcgcgccttcagcagctccccctcccgggcccctcggttccctccgggctcgcccccagcggagagggcccggcgcaggggatctgcccaggatcaactgccctcttccagatccccttctgcgagattcttttcctttggttacaatctcccctccgtgcctggggcagataaacacggttcgccccgcctgcagtattggggcgatgctgtcctggaagaacgggctttctgaatgtgacctcgggatgctgcagcggcgcaatgctgctactgctgaatgagtagctctcctgccaccgcagggcgactgcggtgggcacagcagggcgcacagaggagggggtaatctgcccacccaggctaaggatttgagggttctgacaaaaaagagctggttgaggatgacacagttgtgaactaacctggctcctactaccccacagggcagccaggtcccagtagtcttgggtaccactgcccccaccataccaccattgtaaagtatggactcctgcttagccaacgtgcagctctaggcaggatctctgaaggatgctctggcacacagatggtgcaggtatgactttacctgcacacaagcttacatgtgccctgtcatatatggctacacgtttccccatttccccacagtcttcctatttaactggtcttcaatcctcctttctagggctttccgcctgcacacagtcatttggagaaaatcaagtgagtgcacttctccccacagaggattctgtatgttatgtaacacactcacactgggattcctcaagttaccattttgccccaactcagccagcacttggttttctggcgggggtgtcaggatgatgcaaatggaggtggaagcttcattccctgggggcttttattcccctccttgaagccccagttcaaggcccaggaacaaaggggaaaggtaactgatctctcttttggtctttctctcccctcacttccaccccttcacctgcaggccctcctctttgataaatagaggaaagcccgtgggatcaggtacatatgtaaatactgctgacctcggccgcccctcctcaccgaaaagcagaaagcccgtttcaggtgcaggctgctccgtgcctttgagtgtccaccacttctattcccccagactgcttgggactcaaggccactcacttaatacccgtctcttgttaaaaacattcaggacaactattaaatagttattggaagagttaaagaccttctttcaggagtgaaacgtttttaaagctgtgcttggcataagtctttaaggcgtacaaagtagaatcagtagacttgcctgagcgattttgaaatttgaaagatttctccccatgaaatggtaatttaaaatagtttgtagatgttgttttgttctgtgatggctttttcaccattgtcacctaaagattctcaagaccaagctactaagacatttcatttggttagtttctgggtgatactgtgctttctgattagacctatttaatttatttttaactctgcaggagagttttcaaccttggaaatgtaagtgaaacacagactcaccctccttctgagaccttgataggggcagaaaggaacaaatctggctagcccccctcacacctggaagtttccctgtctaaacctgggtacaatgagcgtggtgggttttgtcaccttttattttattgctggctcaaggaaaattctttgaaatgaacatctattctatttcagtgtgcaatgttccagccgacttaatgggcttgccttatgcggagaggcagtcctgcaggacagagctaatgtgtggtctcccaggaagctcatcagaacacctcttgtcccttttctttaaaagaaaaaaaatttaaaaagtttttgcttccatctcaatgtccattccattattttgtagctacaataaagaaacatgggcagcagtga

SEQ ID NO: 9121 - DNA, 398 bp, Homo sapiens
tattctgcacttttcatatttattcactgctcactgggtcacacagatgattcacacttgattccaccttcctctggacaactctccctcaaacaacacccctctatcaacttatagggaaaggagattcacttagagaaaacttcttgaattaaagaccagactcagtttcgccaggtaactaatcctggcataccggtgactaggaagtcatcacctaacactctacctagatataaactctcaggaaggaggcaggccggtggggacatttccacagacatttctaaaactgtggcaattgagtatattttacagatacaattttggtagattcccatccagcttaagacatttaaaatgcaattttgttcacacgcatgtgcgcgcacacagac

SEQ ID NO: 9122 - DNA, 6234 bp, Homo sapiens
gggaaccctggcggggaggcctgcgcctcctcaagctccagtccctctggatgggtgagtccctccggtgcctttgtcctgtgtccaacttcctttgtcctctccagaggtctctcctgggcttcaccactggtcatggtcctccaaacagcagctcccaatccccaggacagttcttcaggacactaccccttcctcccaggagacccgcaggtttcagctctcctggggccactgctggaccaagtcctcaattgcttccttgccattatcctctttgaactccctctctctcctctaaaagcccctctggctgcagactccttaattgcgtggctgttcctttccagaagcaggtgcgcctgcctcgggcctcttcggactttccatcacaggccaaaggaaaaccagcgagagcttgcatgacaccgggtccgtattaagacaggcgcaaaacgatccttcctcttctgtgcgccttagggaacgcccgaaggcatgcaaggctggggctcaggggagggtccccgagcgggcagtcagggctgccctcaggccctgggcaaggaggtttccggaggcccctcagttctcgagtgtgtgtgtatgtttttggtggtggtaattgggaagcagggggtcaagacccaggagtgcagagagtgggagagaggatctcctccgcccatcctgggctcctgtcgggcctaacctccacccagcgtcaactttttgctgctcccgttagatggcgcccaagactttctaaccacttgtgaaagtgctcctggcccggaacaaaaagaaccgtggggtgtgagtatgagtgtgtgtgagtgcgagtgcgcgcgcggggctggccacagggcacaggagttgcctggcactacgcgtggccccgtcgcgggtcgggtcgggccggcccagggctggggcgcgctcacgggaggagctgcgcgcggccggcggagaactttcttcttttcccttcgctctccctcttgagcgagcgcctaggccctggccactctcccggagagaagccgggcgacccggccgcgggctcaagcagccagcgccggctgcaagtgaccgcggtgcgcgggcggaaaggggtcccggacgtgcgggtcggagagctgggacgcacacgacagcccctttctctgcccttacttaccggcccagcgctcacagccgctgccctgtttttaagagaatggcgcaggtgcaagtttggttgttgcggttttagccgctccaaggaaattgttcagtgtaaggttacctaagcgtactgcgtgggcgtgtttccagaaacaaagggcaaactttctcgctcccaaagccagtgaagttaaacagactcccttatgaaaaggcccttggggaccctagggcgtcagatgcgacagctaattttaaaataactgtttaacaggtgattagggagcgcgctttctctccaccaccaagttcacctcttctccaaacccctctaaaataagtgacttgacgataggtgatcccattccctagtcctctccttaatgccagtctggaggcgcactgtcaagaagggatgcgtctcctcgcccttgagaaccagcgcggagaccttcttttgtgcctctccttggctgtgaactttcccgcgcggtaggttctcctttaagaaagtagcatccctatgaatatttaatgctgcacgcgggccggcggggcggaggggagcccgcggcctgggtttccgcgcgcgccgagacccgggcgcagagcgagtgcgtccccaccagcctggccgccgcgggaactcggggaccgggagggcgggggttagcgggaggaaagggtaagctgaagaggggctgggaacgggagggaggctcggggcgaacgggccgtcgcgttcatttccataagaaagctgaaatcgcagttggaagcaggatttctcgcccctgcagcccttcccccatacccggttttctgcaagaagcgggctccagagctcagagcccgaagtgtgtgctctggtctttgatgatgttgataaaatgtggtttcaaatgttgtcccgaagaggccggtttcctgtctgtatgtggaatggaaggaccgtgccgggtgagtccagaacgccggggagcggacaggaggagcagggctgaggagagggagggcgcagccggcgggcgcagggcatccctgcaggggaagttctccagggggttttgaaagggggagccaggttgaagccaagtttcccgagcaaggaagagtgtgtgtgtgtgtgtgtctgtgtgtgtgtgttcgggggtggggagcgcgatgagggaagacgtcacgaaagccccagaacccaggcggcccgcgcgtgggaaggtctggcaggtcttgtcacctccctcttcaaagagcgggggaaactttcgctggccgtcgctgaccctcttcctgcgaaggaataaagtgaacttgcccagatactggattccactggcggttcagttgttgagttctttctgcgttcgcattgagcattgagtttctttttgacttgcagtgtgaacagcagccatgtgacctcaattctatatcacatatatatacacacacacctcctaggtactttatgatcccatctggagaaattaaagcccagatctgtaatgtttattcttagatagtttaccaaaagcaggggggaaatgtgtgagacacatgtctgcaaatataacaaaagtactttcccttatgcttgaaaagttgcctgcaaatggctggcttccgtttactgactgcaccacctgtacctctccatgaaactaaatggaatcaggaataaagcaccaatcagatcaagcaattaaataccaattatgactattaatgactttattactaatgactggagttgaggactccaaacccaaatgaggtaatcaagctgttttaaaattctgctacctaatatttttaccgcactccttccccaaaataggaggttaaaaaaaaacaggtaatgttttcaaagagttctccagtaggtattcatggtcaatgttgaacttatttttctcagaaagtttattgctactgctggtaaataatggagtcttcctttctggctctgccaagttacgcaaagtgtaactgatgatggtggttacacaatatatggtacttggtttggatgcagaattgggatggagcaggggtgctttctgtcttcaattactctgataatccggcagaccctagacgattttaaggaacaagtgttttaattcttcagatggggtaatggctattgggatgtttggaaggtgaggaaatgaagaatggggaacccaggcagcaaagagaaagaaggaattgggcctatgttttgaattttctttttgctcatgggttgaaatgcctttagcttgtcataagctaagtgactgaaaagaaaaggttactgagaacggtatattggtgtaaaggctactgtgtagctgggtttatttattactgaagatgatttgccaaccctccttgcctcttgattgacaccccttcttatcccaaatggaagtccctgttcattctgggataggaggaagaggcctggagggaggaagggaataaatttctgctgcagtccatgagaagaaaggagggggcagttagtagggattctttagtcaccatgaagcaggcaggctaggcagctgggcacttggaggagccagcagttcatcttgatgtaggtcatctctgctcattgtcccatagtttagctcttcaggacacaaggagtgtttggaacaatgaacttcaagtccctggcttgggatatttccccttcaccttcctcctaggtagaagcctacagcagcagcagcagcatctggttctgatgtgtttaccgggctggtatggaaatgcccaggctgcatggcagaaacctgagctgctagtgacaagcacactcctctgctaagcagcgaaaagttttgatactttttgagcactgggtggcctcttctcttgatgtgaagccatgagcccccctccccatttctatttgtcagagttaattgccctgcagtggggcagctcacacctcaggcagtgccaagaaatacagcagggaaggaatcctgcacatgtaacaggatggcgtggtattaccttagacacctaggggatcaaaaacctcagtggaatgaaatgggcctggggtattctccctttggtgcctccctagggacaagcctctttggcctggcctagactgtgggcagcttatgtatgatggccctgagtcctgaaggtgaagctagtcactttctgtaagtggacagtcgacccaagaggcagttctaaagaggagagcctgaggtgtccacaacaatttcttttctgttccagggcaccaagaggcaccctgagaactcagaggacccagaggctcccctcaagcaaattccctgctgaccctggacaccccttgaaggagggggcaagaggctgccacaaggctcatcttataactcccagcaaggactcccagcaaacaagttcagcttgggatctgcccaccaccaagcctggctgggaggtgggggggagcgaggggcggtggagaggcagagtccctgaacagggaaaagacaatcagttgttcccctttctggtgtcagaggcaaagaagcctgaagggctggtggtggtgctggctctgggtttattgactctgtgatcctgtccagctgtcctacagggagttccagagctctcccaaagtgcatgaggaactgcacaagtaggactggggcacaataccagaagctatttgtctcctagaacctggcaccccctccacttaccttacaggagacccacatcactcagttcccaggacacctggtgggagagtctggtgagatttggaggcagacttcctctactcacaacttgtttgaaaatggacataaagagaagaacagacactccatcgccccttcagggcctcctttgtgtcacaaaacctatcccctcctagggcacccttgacattcccctaggtgggcctacacattgttcagaacctgtcccctgtaccaaaataaatataaatgagtttgtttctttaaaagaaatattacagctttaaacttttcccagccggaatccacctaatttcatcaaggtctctcgctagcagccataacccaggccaaaagggcttgtccctagggaggcaccaaagggagaataccccaggcccatttcattccactgaggtttttgaacccctaggtgtctaaggtaataccaccaccatccccacctgttttcagttctttctttgtggcttaagattgcatttttggagggtttatgtaatgttgttcacgtcagcaagtctccctgccccaccctcaccccactgtcctatatggaattatagttggaaaccacacacacatagaaaatctttgaagatttttttctgctattcttcctgactagaagagttgacaagacatagacacattcagttgcataaaatacagtagcgtgatcagcctaaatgcatctcatttgcactgtttgtaaccaggggtgggggcttgtgtcactcattgcctccccctcctctgcccaaaccagacccgccagctggaatttcagagcaggccccaaggcagcagccatttgggaagtggaagccctagcccaccccagtccagcaggggtgcggggtggatagagaaggtgtctggaggtctggcctgagggcttggaccaactttggcagacctgggctctgggaggcttggccggtgggtgaccacagctggaagttggaggtctgcagcgatgcttctgagcttctcctgagttgagttcaagaaaggggacaccaagaagtaggggaacagtcactgactatattttacatccacgcctacccctttcccagagttgtgttctcaccacccactttgtcggcggaggagaaacactgctgcctgatgcttgcactgctgcactgttcttgcacctgctcctagccctgaactcgggccctgagctcctcactgccgccccctctgcgctgagccccactcctgagaccgcgaggtgccagagcagcgcctctcccaccaactcctagacgcctgtaggacgtgcgccggagccttcagaacccatgggggtgtgggggtgaagttg

SEQ ID NO: 9123 - DNA, 1857 bp, Homo sapiens
gcagacgtggtagaaagacagtaagagaggaacaactagaagtggagcccgaagatgtgactgaactgctgcaatctcatgataagacttgaatggatgaagagttacttaagtggtttcatgagatggaatctactgctggtgaagttgctgtgaacattgttgaaatgacagcaaaggatttagaatattacataaacttggttgggcagagtttgagaggattgactccaattttgaaagaagttctgctgcgggtaaaatgctgtcacacagcatcacatgctacagagaaatctttcatgaagagtcaatcaatgagacaaacttcattgttgtcttatttcaataaattggcacagccactctagccttcagcaaccactgatcactcagttcagcagccatcaacatcaagacaagaccctctaccagcaaaatgattacaacttgctgaagggctcaggtgatcattagcgttttttagcaataaagtatttttagatataatgctattacatgcataatagactagagtacagtatagtgtaaacctaccttttatgtacactggggaaccaaaaaattgtgtaacttgctttattgtgatacttgctttattgtggtagtctggaacagatcctgcagtatccccaaggtatgcctgtatctcagtatagtcgtgatcataggtcttgcttttctttagattcactgttggtgttatcatccatgaatttcaccttcctgtgtacaaacatctcttattacagtaggagaatatgggagtcagaaaaggaagacatttattgtcattatgaactcagaaatatgttttctagtgatcattgaaacaactgagattgatattttccagccacggcagttttggtgattgaaagcaagatctgttttttaaaaattaaatataagtttgcacattcttccagggaagggcacgggataatttcccttgccattttattttgaaaccagctttgttgtggtggcacgctccatgagatttgctccatgagatttgctccatgttgcaccacacacagtctttgctcctgtgtccttccatagaaaaaaacagtgtggggaaggatttggtttgtcttaccctttaatcttctgctcctacagctctctggtctgatagttcactattttggtaataaagtcagatatagttcaaatcctgtctggtctattatttcgtgaaatttttgaacttttccatgctttggcatcctccaagaactttttcctttctaagttttactgttttaatataaatggactcctatgtgaacacttttagactggagtctaaaagtggcctaataggcttgctatttttagagaaggagaaagttgccttttgttctctctgtgcttttcacctcccacatgttctttagagttttttttcctgttctggtcttagtagtgacagctttctaattccagaggctttttcctgggtctgtttctggctcattttgtctcatactcaaaatttttaatgtcagaattgggctgggctcttctctttctattatctgtaaacattttgggtttcttttcctctaatttatgaaaattatgaaatgtacacataaaggagtggaaaatatattcacccagtttaaagaagagtaataaaatggacattcgtatatacccaccatccaggttgagaaatagaacattgcttgtgtctcagaagctctctgtgttcctctcagtcacgttcccccaccccaactcctacccaaggtaacctctcatcctgaagcttacatggaagatttgggcatttttattaaaaaaaaaaaaaagaaagaaaaa

SEQ ID NO: 9124 - DNA, 11121 bp, Homo sapiens
ttttttcacagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtagggacaaggaggattaagggtttgtttttaggtgttttattttgtattatgaaaataaatctaacaatgacagttggactcagacttctttatatgaagtcaactattaaaattttctagtataaacttttttttggctacacatttaaatgtaaatattttaggtgaaaaggagaagtactgaggtgtttcattataaaaggtgatgatccaatggaggtaacattcagaagtagagtttaattagctgctaattagcacaggaatcgtggaacaggtaactcaaaatttacattacttagaacaagaaaaaagtcagaataatgcagtcttcatttgtgaagcttacaatcttctcagattagtgtgctcagatctgggaatattttctgttagaaatacagaggaagataaaagaacttgcagtagaccatgccactgaagagtaaacagaaagcacagagaaagaatttatagttttaagtattttcttcacaagtatatgaaatttatgaatgagatatggtataatcataaatacctgtgcaatgttatcatgttctcgactataaaatggctgtgtattttcattataagcaagcaaaacatgtgacttcagcctttctcaagattttagataaactatatttaagctcacattaaataccatagctagttttaagatacccatttctttttttctaaatagatatgttgttcaagggtattttgaaattctgatgtgaatcacatccaagttagtgagcaatttttatactttatacctaggtataatatagattatctgggggaagaatgtcacatacgtggtattacgagaagaaagtatagtttacagcagttctacaaatagtattggtactttcctggtttcaaaaagtctaactgtgtttaatttggaacaattaaccaaattatggtatatttgtgaacaagtagatactaagaatgaaaatattttcttcaaagaaatgtagtaaatcattattttcgtggccccattaaagtaattatcaggttatgattaaatatacttactatatttctcattcagcatacatagtctagtttttaattcattccctatttaccttttagcttcttttttctcctccaggcatgatttgctttcttaagaccaagttttgaacaagtgattggaaaaattagttaatatgcccatattacgtgaaagtactgtctggagccattaccagatgacagtgttgagggctaataagaaatttctgttcatagtaaataatgtgttaccaaatgagattataactttttgtatttttatttgtctcattgaatggctagtcatttttttctgttaatgacctctttttgccagatatgcaataactgcatttatgttgatgccagccttagtgaaaggcttattctacagtgtatggaatttatcaagacatttttacgatgaaaatgaaatccaaattgatcttaagcagttacactatgtaccttcaaaaaatagaagtaaaatttctgaaacttacgctgtagtccagtacagttaaaatgtataaaagaacctagtgccaattttcttaggtcttgcgaaattaggttacttattgttttggttattaatgaacaattgccaatgtgaatgaaatcttttgttaaattataagggaaagtttcacatgcagcaaaataatacagaaaatgtttttataaatttttataaaacttgaatctttaatgtttgtttttaccatttactgtattgttggtctttttacatttggccatagttctatgaaatgtaaactttttcaggaaagccatgaaaaataatttagatagttatttcttaaacatgtgacttgtgatagttttgatattaaagacctttatcactccacagaacatttttatttaaactttaatacagttgaccagaattgcaatctaattaaatatatcaatttgttgactggctgaaatttaagatcctttcaatgataatcatatcaaaattacttcttttggttcaattatatttaccattacataaaactacaaaacatttggttaatctttccgtgggtatacagtgaaataggtagccagaccaacacctctttattttttattgggttgtttgatgagctgttctacttctaaaagatttaatcttgtttcattctaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattctcagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaaggtaagcaaattgttaatcacatctcataaaatgtgcctagctttcagtaatatgttctagaagatagatctatatagtatatcagtttatctaaaacttttgaaactcattctctgtatttctatttttcaaattctctgatcaaaaacattaaactccttttctagatttcctaggtgatctgaaacttcagaagtgttttccaaactgtactatgacactattctatgacactatttctagtacaaagcaattttattttttagagtgtccacaaactttgttaaaatatgttctctttttaaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaagtttttgcgtgttatttttcctgagaagtaatttttaggtaaagatcttaaagatttacactttttaagagtttataaacatccaacaagcaaatctggatataatttgagtggttcttttaaaccacgtcagtaggccatctcttaagtaatttataatctaaaaataaataggatagaatatgaaaactgaattttcttggcaaaaccaaaaaattgggcttaatcttaagggggtaagatagccataattagaaatattttggtcattaatgtgattctttctttaccttctgattccatggcaactgagaagtgtccactgtacagtgggcaaaggatgaggctgtacacagccaaagaaaactgcctcaggggtagctatagtgttatgtctcttggaaagctatacagacgaaccagtatagaccgaatagatattaatataaagcaaattaagtggtattaatataaaacaaattaactggttacttatgcaagtttcgggagctacttctatgttttcatcattcctgttggccaaagtcccaggaatcagtttcctgatcaccacttaactggctgaaagtcgagtttttctgctttgctttggtgacatctggcatgccccctcagcaccatttatcaagtaactaacttagaagagaagaaatttataaaacaaagcaaaatactttaagcttgttcactgtccatcattctcagaatagctactaccttctcaacctttaaactgccacccttcaaacaaacagccctcccctttctagatacagagttttggaagtgtcagaaaggagtcctacataaaacaaaggatgttttaaaaactactagctttcctatgaaaaaaaattacttgagagttaaatgactcactttagagttaaataactcattttaaactactctttctgagctaacgaagtcacattaatgcagtttttcataagtttgtcagctttattaactaaagtcaaaataagtgaataattattccagtaggcctataaagcataatacaaataataattatgctatcaaatcatagagcagcatttacatatagctcacatgtgcaaggctgggagatatctccacttaggtaaggatagaagtcaagctactataatttccagaatcatctactgtgtaatctatacacttaatctctcttgaacatcagcaaatgacatcatatggcaaggcactcatcaaagaatttaaccacctgttgtcttcagtacactgagggggtctgattaggatagtctataacaggagttgccaaaatttggcttggctagttgcctgttttgtgaataaagttttattggaacagagccacatcaatttgtttatgtattgtctatgtgggcttttgcactacaatggcattgttgaatagttctgacaaaaactgtatggaaagtaaactgaaaatattttctttctggccttttaagaaaaggtttgctgacccctgctctacggcattattcttcgagtattagaaagcaaacagatcatcataacttgttaaaatgcagatctcattcaaaaggtctaggagtatgacctgagattctgtatttctgagaagctccagatgatgccaatacagctggtctgcacaccccactttgagtagcaaagggctcaaggcaatgcaataatctactgtgatagagcattggttctcagcctgggttgatcctgccccacagaggacatttagcaatttctggagacattttgggttgttacagctaggaggagatactattgacacctagtagataagtactaggaatgatgcgaaacatcctacatcacaggacagcacccccacaacaaataacagctcagctcccaaatgtcaacagtgcagctgtcaagaaaccctacattagaatagttattaactttgaatgcacatcagaatcgactgggaagctatgaaaaatagcaacactacttccactctggccatgaaaatctgataccagacttccccttctgctgtgaaaacccataaataaataatagaaaacaaaattagtcaaaatatgtgaaataacttagggatctaaaacaaagctcaggaagggaaaataacacagacctaagaaaggccacaatttaagatttactgcagactaggccaaaaaagcctgaacagaacttataaaatgatcaggtttagtcaccagtaagttaactgtctgccagaactaacctcaaaactctttaaaggaatgcaataaaatctggagtctaaagaccacagcatccacaatgttcagtatacaataaaactactacaaatgagatgcaggaaatgtgacccataaccaggagaaaaaattaacagagattcagggctgatccagatggtacaattatcaaacaaggactataaaacatctacataaatatgttcaaggaattaaagttgaacataattaatgaacagatatgggggaggtggaatctcaacatacaaagaaatatacttgtggaactgaaaaatacagggtataacatgaaaaattcattggctaggtttaacagctgatttgacaatcaactagaggtcaggcaaaaacaaaacaaaacaaaacaaaacaaaacaaaaaaaacaccaccacccaacctgaggtacagcaacataaaagactgatttaaaaaaatagttatttagctgcctatgaaaaaggtaaagtattctaacatgcatgtatttggaactcagagaaataagagagattaaggcatgaaacaaattgatgaaatcatacaaaacctttccaatttgaagacaaatatcaacccacagataaaagcagctctacgaacccaaagcacaataaacaaaagacagccatccttacaaaaccaaaaataacaagcaaatcttgaaagccacagaaagaaatacattataaatgggccaataagaataactgctaacttcttagcagaaaaaaaaacagacctatgaagatggaaacatcctttttaaagttctgaaagaatagattccatattcaatgaagctttcaaaatcaaagtgaggggcatccagttatagacaagaaagagtaagcatcccaccttattctggtaattaaagagtggacaaaaagcacctatcaaaacactgaaaattctaaaaatgaccctcccttgagtctccacccgccatgtactttagtacctcctattaccccagcctgggccataaaagagcctgcgttctggaaacagcaatatgcacagactggaaaaaaaaaaaaacaaacatgaaaaacatgctctatgtaaccaatagccctgggggaggacaggtctacaggacagaatctttttatacctgctgaaccctaggtgaacaccatgaaagaagctgtaccttacttctctccaggtgctgtggaaacggggcggcggggtgggggggatggtgggggcggtggggaggtggcaagggtggggtgaagagggagggtacagtcctgttgagtatcatcaccctacactaaccagggagcacacctacccttcccccatcaagcactgtggagacaggtagagccctgttgaccgtcctcacactaacaaggtgataccctatcccactgggtgttagggaaattgtgagatagagctctgacaacctttcccagcctgtactactgaggtggtcccccttccttcccaccaggagactaccaaaactgtaaggcagagccatatagcctgttcctccctgcactaacacaagcagatgtggtacctgtcttcctccccaccagacactgtagagaccgtagtagagagctaccaaccttctccaccttgcactgagcaaacatcagagcaacagcaaccctccactctggcctcagaaactggagaggcacttgcccttttgaccgtgcctgctgtgcattaaacagcaaagagttggcatcgcacatctccctaactagaaagctctgttctcagtaattgatataactactagagtgaaaatcagcaggaatataaaataaatcagtaacatcacaagataatgggatctagctgatatttatagactacttcacccccaaacaggaaaatacatgttcttttcaactgcaactggaacattcaaccaggcagaccgtcatatcctatccataaaacaaaccctaacaaatttatattgttagaccataatataattaaactagaaatcaataactgaaaaaaaaatcttcagatacttgggaattaacacatttctaaataaggtattaaaagtctcaaggggaaatatattttgaagtgaacaaaattgaaatgtataaatatttacaggatgcagtacaaacagggtttagcaggacacttatagcatggaatacttacattagaaaaaatagtgggttcaaatcaatagcctaagc

SEQ ID NO: 9125 - DNA, 11119 bp, Homo sapiens
ttttttcacagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtagggacaaggaggattaagggtttgtttttaggtgttttattttgtattatgaaaaatctaacagtgacagttggactcagacttctttatatgaagtcaactattaaaattttctagtataaacttttttttggctacacatttaaatgtaaatattttaggtgaaaaggagaagtactgaggtgtttcattataaaaggtgatgatccaatggaggtaacattcagaagtagagtttaattagctgctaattagcacaggaatcgtggaacaggtaactcaaaatttacattacttagaacaagaaaaaagtcagaataatgcagtcttcatttgtgaagcttacaatcttctcagattagtgtgctcagatctgggaatattttctgttagaaatacagaggaagataaaagaacttgcagtagaccatgccactgaagagtaaacagaaagcacagagaaagaatttatagttttaagtattttcttcacaagtatatgaaatttatgaatgagatatggtataatcataaatacctgtgcaatgttatcatgttctcgactataaaatggctgtgtattttcattataagcaagcaaaacatgtgacttcagcctttctcaagattttagataaactatatttaagctcacattaaataccatagctagttttaagatacccatttctttttttctaaatagatatgttgttcaagggtattttgaaattctgatgtgaatcacatccaagttagtgagcaatttttatactttatacctaggtataatatagattatctgggggaagaatgtcacatacgtggtattacgagaagaaagtatagtttacagcagttctacaaatagtattggtactttcctggtttcaaaaagtctaactgtgtttaatttggaacaattaaccaaattatggtatatttgtgaacaagtagatactaagaatgaaaatattttcttcaaagaaatgtagtaaatcattattttcgtggccccattaaagtaattatcaggttatgattaaatatacttactatatttctcattcagcatacatagtctagtttttaattcattccctatttaccttttagcttcttttttctcctccaggcatgatttgctttcttaagaccaagttttgaacaagtgattggaaaaattagttaatatgcccatattacgtgaaagtactgtctggagccattaccagatgacagtgttgagggctaataagaaatttctgttcatagtaaataaagtgttaccaaatgagattataactttttgtatttttatttgtctcattgaatggctagtcatttttttctgttaatgacctctttttgccagatatgcaataactgcatttatgttgatgccagccttagtgaaaggcttattctacagtgtatggaatttatcaagacatttttacgatgaaaatgaaatccaaattgatcttaagcagttacactatgtaccttcaaaaaatagaagtaaaatttctgaaacttacgctgtagtccagtacagttaaaatgtataaaagaacctagtgccaattttcttaggtcttgcgaaattaggttacttattgttttggttattaatgaacaattgccaatgtgaatgaaatcttttgttaaattataagggaaagtttcacatgcagcaaaataatacagaaaatgtttttataaatttttataaaacttgaatctttaatgtttgtttttaccatttactgtattgttggtctttttacatttggccatagttctatgaaatgtaaactttttcaggaaagccatgaaaaataatttagatagttatttcttaaacatgtgacttgtgatagttttgatattaaagacctttatcactccacagaacatttttatttaaactttaatacagttgaccagaattgcaatctaattaaatatatcaatttgttgactggctgaaatttaagatcctttcaatgataatcatatcaaaattacttcttttggttcaattatatttaccattacataaaactacaaaacatttggttaatctttccgtgggtatacagtgaaataggtagccagaccaacacctctttattttttattgggttgtttgatgagctgttctacttctaaaagatttaatcttgtttcattctaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacaacttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaaggtaagcaaattgttaatcacatctcataaaatgtgcctagctttcagtaatatgttctagaagatagatctatatagtatatcagtttatctaaaacttttgaaactcattctctgtatttctatttttcaaattctctgatcaaaaacattaaactccttttctagatttcctaggtgatctgaaacttcagaagtgttttccaaactgtactatgacactattctatgacactatttctagtacaaagcaattttattttttagagtgtccacaaactttgttaaaatatgttctctttttaaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaagtttttgcgtgttatttttcctgagaagtaatttttaggtaaagatcttaaagatttacactttttaagagtttataaacatccaacaagcaaatctggatataatttgagtggttcttttaaaccacgtcagtaggccatctcttaagtaatttataatctaaaaataaataggatagaatatgaaaactgaattttcttggcaaaaccaaaaaattgggcttaatcttaagggggtaagatagccataattagaaatattttggtcattaatgtgattctttctttaccttctgattccatggcaactgagaagtgtccactgtacagtgggcaaaggatgaggctgtacacagccaaagaaaactgcctcaggggtagctatagtgttatgtctcttggaaagctatacagacgaaccagtatagaccgaatagatattaatataaagcaaattaagtggtattaatataaaacaaattaactggttacttatgcaagtttcgggagctacttctatgttttcatcattcctgttggccaaagtcccaggaatcagtttcctgatcaccacttaactggctgaaagtcgagtttttctgctttgctttggtgacatctggcatgccccctcagcaccatttatcaagtaactaacttagaagagaagaaatttataaaacaaagcaaaatactttaagcttgttcactgtccatcattctcagaatagctactaccttctcaacctttaaactgccacccttcaaacaaacagccctcccctttctagatacagagttttggaagtgtcagaaaggagtcctacataaaacaaaggatgttttaaaaactactagctttcctatgaaaaaaaattacttgagagttaaatgactcactttagagttaaataactcattttaaactactctttctgagctaacgaagtcacattaatgcagtttttcataagtttgtcagctttattaactaaagtcaaaataagtgaataattattccagtgggcctataaagcataatacaaataataattatgctatcaaatcatagtaagagcagcatttacatatagctcacatgtgcaaggctgggagatatctccacttaggtaaggatagaagtcaagctactataatttccagaatcatctactgtgtaatctatacacttaatctctcttgaacatcagcaaatgacatcatatggcaaggcactcatcaaagaatttaaccacctgttgtcttcagtacactgagggggtctgattaggatagtctataacaggagttgccaaaatttggcttggctagttgcctgttttgtgaataaagttttattggaacagagccacatcaatttgtttatgtattgtctatgtgggcttttgcactacaatggcattgttgaatagttctgacaaaaactgtatggaaagtaaactgaaaatattttctttctggccttttaagaaaaggtttgctgacccctgctctacggcattattcttcgagtattagaaagcaaacagatcatcataacttgttaaaatgcagatctcattcaaaaggtctaggagtatgacctgagattctgtatttctgagaagctccagatgatgccaatacagctggtctgcacaccccactttgagtagcaaagggctcaaggcaatgcaataatctactgtgatagagcattggttctcagcctgggttgatcctgccccacagaggacatttagcaatttctggagacattttgggttgttacagctaggaggagatactattgacacctagtagataagtactaggaatgatgcgaaacatcctacatcacaggacagcacccccacaacaaataacagctcagctcccaaatgtcaacagtgcagctgtcaagaaaccctacattagaatagttattaactttgaatgcacatcagaatcgactgggaagctatgaaaaatagcaacactacttccactctggccatgaaaatctgataccagacttccccttctgctgtgaaaacccataaataaataatagaaaacaaaattagtcaaaatatgtgaaataacttagggatctaaaacaaagctcaggaagggaaaataacacagacctaagaaaggccacaatttaagatttactgcagactaggccaaaaaagcctgaacagaacttataaaatgatcaggtttagtcaccagtaagttaactgtctgccagaactaacctcaaaactctttaaaggaatgcaataaaatctggagtctaaagaccacagcatccacaatgttcagtatacaataaaactactacaaatgagatgcaggaaatgtgacccataaccaggagaaaaaattaacagagattcagggctgatccagatggtacaattatcaaacaaggactataaaacatctacataaatatgttcaaggaattaaagttgaacataattaatgaacagatatgggggaggtggaatctcaacatacaaagaaatatacttgtggaactgaaaaatacaaggtataacatgaaaaattcattggctaggtttaacagctgatttgacaatcaactagaggtcaggcaaaaacaacacacaacataacagaacaaccccaccaaaacaccacgagccaacctgaggtacagcaacataggagactgatttaaaaaaatagttatttagctgcctatgaaaaaggtaaagtattctaacatgcatgtatttggaactcagagaaataagagagattaaggcatgaaacaaattgatgaaatcatacaaaacctttccaatttgaagacaaatatcaacccacagataaaagcagctctacgaacccaaagcacaataaacaaaagacagccatccttacaaaaccaaaaataacaagcaaatcttgaaagccacagaaagaaatacattataaatgggccaataagaataactgctaacttcttagcagaaaaaaaaacagacctatgaagatggaaacatcctttttaaagttctgaaagaatagattccatattcaatgaagctttcaaaatcaaagtgaggggcatccagttatagacaagaaagagtaagcatcccaccttattctggtaattaaagagtggacaaaaagcacctatcaaaacactgaaaattctaaaaatgaccctcccttgagtctccacccgccatgtactttagtacctcctattaccccagcctgggccataaaagagcctgcgttctggaaacagcaatatgcacagactggaaaaaaaaaaaacaaacatgaaaaacatgctctatgtaaccaatagccctgggggaggacaggtctacaggacagaatctttttatacctgctgaaccctaggtgaacaccatgaaagaagctgtaccttacttctctccaggtgctgtggaaacggggcggcggggtgggggggatggtgggggcggtggggaggtggcaagggtggggtgaagagggagggtacagtcctgttgagtatcatcaccctacactaaccagggagcacacctacccttcccccatcaagcactgtggagacaggtagagccctgttgaccgtcctcacactaacaaggtgataccctatcccactgggtgttagggaaattgtgagatagagctctgacaacctttcccagcctgtactactgaggtgtcccccttccttcccaccaggagactaccaaaactgtaagcagagccatatagcctgttcctccctgcactaacacaagcagatgtggtacctgtcttcctccccaccagacactgtagagaccgtagtagagagctaccaaccttctccaccttgcattgagcaaacatcagagcaacagcaaccctccactctggcctcagaaactggagaggcacttgcccttttgaccgtgcctgctgtgcattaaacagcaaagagttggcatcgcacatctccctaactagaaagctctgttctcagtaattgatataactactagagtgaaaatcagcaggaatataaaataaatcagtaacatcacaagataatgggatctagctgatatttatagactacttcacccccaaacaggaaaatacatgttcttttcaactgcaactggaacattcaaccaggcagaccgtcatatcctatccataaaacaaaccctaacaaatttatattgttagaccataatataattaaactagaaatcaataactgaaaaaaaaatcttcagatacttgggaattaacacatttctaaataaggtattaaaagtctcaaggggaaatatattttgaagtgaacaaaattgaaatgtataaatatttacaggatgcagtacaaacagggtttagcaggacacttatagcatggaatacttacattagaaaaaatagtgggttcaaatcaatagcctaagc

SEQ ID NO: 9126 - DNA, 274 bp, Homo sapiens
gagccactgcacctggcccactttttaaaaaaatatgtgtagaaggttagaacagttgaatccagcacagtggaactgagcatgaattcatccaagtgtaaaccttgactgaagtgacaaaatgggatgggttttccttaagtattaggtataaaatacatgtttaaggaagtggctagtttcttttcatcttagggtgtatcatattcttaaattattggtgtggccagttatttcagattgaaaacgtttgtagtatgtgactttacatttt

SEQ ID NO: 9127 - DNA, 274 bp, Homo sapiens
gagccactgcacctggcccactttttaaaaaaatatgtgtagaaggttagaacagttgaatccagcacagtggaactgagcatgaattcatccaagtgtaaaccttgactgaagtgacaaaatgggatgggttttccttaagtattaggtataaaatacatgtttaaggaagtagctagtttcttttcatcttagggtgtatcatattcttaaattattggtgtggccagttatttcagattgaaaacgtttgtagtatgtgactttacatttt

SEQ ID NO: 9128 - DNA, 2281 bp, Homo sapiens
cctccctcatgggttgtatttccctaccttcccatacacttctctccctaaggtcttatctaaccatcattctcttcaagttgccatttccattccctacttcccagctatgcacctttctgttccatttggttgacttttatttttttcttctttccagcacatggctttcagttttcctgcctctgctggagttgtcagggttggagccaggagggctttactttttccttttcttctaccaggttagcccggttggtttatgacatctcctcattttcaactctcctcatctcttttcatgtggctttgttggggttggatggctgaggttggctggactgatggttacaaaagaatatgtgagagtattgagggagtgactaaatccctcagggataagagagggaacaggaccttccagaaggttgtgctcttattgtctcagactttgtatatacatgtttatttctgtaaattgctttctccatttggacaaactacaataaccagagtaaaaagctaccaggaatgagttctgttcaaaattacagagatggacattggagtctcagtgagtttgcttgagagttctcggaataatatgaaaatagctttaaaagggacaacaggagagtatgcagagtggagctgcttcttttttttttgatgccgaaattggtttagatagaatgaaactgtctctcttaagattcgaaaaataaaagccaaaacaacccactcatctctcaaatcccggttgagctaaagctacaaatcacattcatttgtaggatacggttgagagatgactctcgagtaatgaaggctcataagcctgggctgtagttagtgtaagaggtaaacaggggccttcttgttttcactcttttggaagctctaattcatttctaattactatctcctggaaaaacaccgtgttgtcattgccttttaaatttctttctcttttcagagaaaacacatattttaggtcattaagaaaaaccttgtcttaatttggatgatgtttttattctacaaaatagaattattatcttgttcgaggcacaatttggtaagaagaagaggctgcatgcattttaatttggcaatgaattaacaataataaagaggatatgacttttccactgttacacagttcagatctacatgcttatgtaggtcagagaagaagcatccttgctatttgaatttttacagggaattggtcaggaggaaaaaataatggcatgtgaaatatcaaaacctttccttaattttcaactcaataacgtgttttgcaattttaaaagtccatgaagaagaagaaaaagaaaaagaaggctttacaattagtaggtgtgaaaaagaaaaaccaatattgttttgtatagacaaggaagcagaatgtggcaaaaattagcttttgttgtttttcatattatgaaatattccccaacacatatgaaagtgtaagtaggcaaaaatttttttctcactcataagctgaggttaccttggttatttttttgaacaacttagtctgttcttatggtaatttggggaaacgtatgaattgatgggataaacttttccttgagattgtgaatgaaaatgggctcaatggagtgccatggtcttcctcagtgcatagcagattctgaagacatcacatacacaaattgtccaccacttctagttccaagagaaggtgtgagaaaaaggggtgaagggaccagcattgcctggcaagatggttgggggagtaatcagctggggagaccaccttagtctggatacagacgagagaggggaccagagaggtctcagactttgccattttacttcttgatttactaatgggctccaagtgtgaactgtaatgtagagagtcaggaagaaggtaggtcttaaatcttgttaaaaaatggatacattcttaaatgcttcagcttgtagagaagagagaagaaattttgattattccttatgcctctattaaaatacctgggaaaaccatttactcaattgatttttaccagctgcatttttgtatgacataggtaaactatatttgttttaacaagtaaagaccaaaaatgctgatcgcaaaaagaaaaatacattattcacaattctacctctaatagacgggtactgttgtgtgtactcgtatacacacgtataatataaaatattatatttgtgtgtgtgtgtgtatgtgcgtgtgtgtgtgcgtgtgtgtattctttcatttggcaaaccaaaaaaaaaaaaa

SEQ ID NO: 9129 - DNA, 3305 bp, Homo sapiens
cagatggagttaactacatccgcactgacgaggaggtaatcatttagtaaacctggaaacctaggtgtacccagcagggaaaacaacattcccccttggaaaccacacgggtctcctgggaagatttctgagtgattgtgcagctcctgagctcctcagccccttcacagtaacacacacacacacacacacacacacacacacactaatgggatttgtgctttgcaagcgctagtgatggtactttttaagaatgattattccatctgtatttagcccatgttagacttactccgtgtttttccctgcttgccaccaggccccttgatggctctaactgtgtgttggctttgcagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacagaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaacattgcttcattctttgttatttgctcttacgttgggtttgtctcttcttcctagcatttcagtggttaggcatgcacactaaaaatgctatcaatcacccatccaccagggaagtcagtgctgggcaggaggtcagcctgtgtgctcaagagcagtgctgcgcctctccgccaccgagcccacctgtgttgcggttcccacttgggatggcagtgggcagatctcagtggcatcccatcccccaaaccaaccaacgcacatcatcactttgtacttttgcttttgtaatactgggattaaaaaacaaaccaactgcatttctttctggatattgttgaa

SEQ ID NO: 9130 - DNA, 7627 bp, Homo sapiens
ttcaagacaatcatcttttttctaatagggaagatttggtttcattcctctaacaaacaaacatgctttatgtaaaattaaaatgattaccaataagagctctgttctaaaaacagaaaaatcctattgactactggaaggctgtatttatgctaaacctttattacttttagaaagctgtacacttttttaaaaaatttgcacttataaataatagaaaaaatattagaatcaaaatttcgtcattacagatgggaaaatatgtactataaggaattcaagttaacagaggcttgatttatataaaagaaagctgcagttttaaagttgtgttccttaaagaccagattatagcttatctgaatgggcttgacactttcaaatggaataaagttacaatattaaacagattagggtaagaaaatctaaatctggcacatctctattatttgacagtgtttaaccaaatacatcataagaatagaaggtgagtgccaggcccctgaggaggagctctcgtgttccacagcaaagcgctgcccaaggactgcgggaagtgatccagctgccttcacacggaggacacgagactgcttcctcaagggctcctgcctgcctggacactggtgggaggcgctgtttagttggctgttttcagaggggtctttcggagggacctcctgctgcaggctggagtgtctttattcctggcgggagaccgcacattccactgctgaggctgtgggggcctagggaaaggacatgtgcagtcattctggaactcagaaaaaccctgacagaaacatccacctcaaaaggaacactgctaaacttacggtttatcaggcagtgataaacataagatgtcatttccttgactccggccttcaattttctctaaaagggagtcaaacaaacacattcagctttcccagaacctcaaaggcagtgcatctatcagcccagaaggacaccaagaacttgcctttggctgacgacggagtccgtggtgtcccgatgtaactgacccctgctccaaacgtgacatcactgatgctctctgcataaagaggagacaccactgagtgaaagccgcgtggtctatcggaggtctctgttctagttgtccgtgggacgtaggcagggtgtccacatcagtgtcccagcggcggccctcagacctccactggaccctgtcccagggcctggcagtgttgagggcccctcctggggatgctcctttccgtctctctgacccccttctctgacccgcagccctcaggcactcggctggcccctgggcctcactgttcacgcctctggcttccctcccgccgtcttccatcattgcccctgtcccggtgaccgccctgtcccacttactacacctcctactgtggctcacccagattccctgaggacacttcaactccttgcctctgcacctccacgcgtgcctgctggtttccagccagtgactggagcatgcgcgctggaaatatggcaccgtgagcagctcctccacatggaatcagcagccaagtcctgtcccttctacctccagtcgccgcctcatcctgtcccgtcgtgccacactgggagcggctcagtccacctcccccctcgcccttgattgttcatggcacctacccgcaatgaaccccctccagtttgccctcaggaacaggagaacacagttgagcagattccaccgcagcttgggtgtgaattctggctcagtgtctcaccagctgtgtgagctgctctgagaccctcaggtttcttcatctcttaagtgggtataaaaacatagctacctcattggggggctgccaggactacatgaggttatccacgttgagtgcttagcatcgtgctggctgcaagggcagtgctcaagagatgttagcagccactgtcatttattagcagtatcatccctgcatcactggagttatgtttcatcaagaagctggtaaatttactgccctgcttcaagacacctcaatcgctgtgttcctaggagagcctgaagtccaccctcagtctcagctggtcccaagctgcctttacagactcacctgttaggctcaggtgcacgcgtgcacaaacacgtccaccctcctgcgtcctcttcctcagcaggccctgtctgcacattatgcttctctgcacccccccccccaccgccccatctgcctacacatgccaccctgtcttggaggcccgggtggtgcagcctcacccctcctgggtggtgcagcctcgcccctcctgggtggtgcagcctcgcccctcctgggtggtgcagcctcgcccctcctgggtggtgctgtacccagtgcataagctgccaccagcacactcccgggaacagcacgggctgggcagctgcttgctggtaccactgaacctgctgcccttctgcaagcacatgcgaggaggcagcttcagagcgctccccgttctccacttggtgtcttgagtatggactgtgtcttcccatttacagttcaaagctcatcagcgcactgcagctgtgtacccgatggctacttgagtgtcactaatagacgatggtagagaattcctcatcactgctagatctgcttattctgtttcggtgaagtctctccttgtgctgtcacatgaaattcccttcctgacacacacactgctcttcctgtttggaagcccatatgcactccaggaaattagtctcccatctttacagaagcccgggtgcgggggctctgacgtcccccatgcactgtgcgtagaatcgaaggcagcagcgtctgtgccacccgaatggtaacagtaacagggacttgctaaaacccccacagattttcagttaaaatcctcgctctgaaaattgactaattttcatttccatttagcaaagccactgtgaattggtgctgaactgggtggcatctttcctgccagctttgaagagctgagacacttcctgacagtctcccccacctaaactaaaagttgccaaaaagaatctggacgtataaaccacagagaaaacagaactgagtgcttttaaactatctaacagttctcccaggaaggggagacctccaggcatttcttcctggttcagtataaagagagacggacagagactgcatcagcaggaatattatgtccaagagcctggagcaagaacaagtactctaccaactcaatgacaccgggcgcctgatttccagcacaaagcgtggctccacacaggcagatgagggcggcatgaaccctccacgccaggctgccctgtggagaaacacgagctgctaggaaacaacccaacactgacatcagggactcaggatgagcacaacgaaaatgagatgcgttctccccgtttcttcagcatatggcacctcactgccaaaatagaagctcttggcactcctgagccaggaacatcgaacacacagcaagctctaacacacagaacatcgcacctgtccacgacgcaggatcccaaattacccactgcctttaatgacaaatgccgtcatgattcggttgtcgtctgagggtgggggtgggataaactcccttcaaagggggacctggatgaaaattacctctaacctgttaactattctaagagatcacagcatcagtgtgacagaaccaaacaagcaagtagctagaatacagcaggtgctccacacacatgagctgactgaagcagtgactaaacgaacggcaggacaccttgctgctctgttaccaggaagagcaccttagcacgctctcatcttcccctgcagtcaggactaggagacaggctggagaaggggcacaagagttgggaccagaaggcctgggctcagcgcccagctctgccctcccagaagtctccgggaggagatctctgacacctcccaggttccaggcactgtggtctgtggaaacagtgaggagtggaatggccagggacgagcggggctggatgcagcttgctgagggcactgtgcacagccgggcgcagagcgaggggcacacagggacacggcggcagggcctagccactactccacagatttaggacaggaagcatttcttcttcctgtaagagttttctcaaaataatggtttttatgaggtttgacacaatatgaagctatcacacaagataataggaaaagaatactcaactctcctaactcacctctgttttgaaatcaaaggaaaagcacaaacagtaggaaaaaacatggaggggaatgagacacaggctccgagcaggggtccccgggtctctggtcttggcagttgcagagcgtgcatggtacctgctggtgctgacgtctgcccgccctgggagcaggcccacccagcagcgcccagtgcacccggacagcccagagacacggagggccgcctccagaaggcaccactgggtcagtcacccaacctacctgtgcctcaacggcattgtctgctccgcgggccactgtggtgtttgactgactgaatgtaacgacactggaacaacatactcggtcagtgctcatggatcaagcgaccgtggtcactgtgaaatactccacctcagcaatgcactcatggttctgaccatcagaactatcctgcaccggaaggagttttactgcgactctagcaaacacatcacgaatgcaggagagactgaggagaagcccacgtgttccgatcagttactcactctcgggggtgctgatggcccgcttggtcacgtgctcaatctcgccattcgactcttgctccaaactgtatgaagacactagaacagaaaaggtgctgctatccagaaatacccccaaacaataacgaagagcaaaacaaccacatgagaaaacatatctgcaagacgtaaagtcaaaatcactagtgtttacaattttcttataaagaggcaattcaggaagaaatacaaataaatgataaacatgagaaaaaatgtccattctcattaggattcaaaaaaataaaagagtctaacttggcataagtgatagaggacagtttgacactatccaaagtttttaaatatccatggcctttgactgctgggaattaatcccaaggattacatacatacaaggctatatgtacaaggatgtttactgtgatagtatttgtatggaaaaattgaaaatcaacatttcaaagaacaggatagtaataaatcagttatttccacagccacaatgctataaagccactgaaagcaaaggttggaaagaaaagttcatggaagctgtctactacatctactacatctgacttaagaatgcagggaaacaggtcataaaacaatgcacgcacagatcacaattccataaacaaaacaaaacacgtgtgtgtaagaggaacagaatagctggaggaaggaatgcctcactgctatgggtgagtttcatatttcactctattttccaaatctcctagaataaatatgcattgttttactacccatgatcctaaaagcccaattaacgttatttgttttaaagataagaaaacacaccgctttgaaaggaataagaagtagcttgttctgtgttttcatctgtaaatgctctactgtgtctggcaccaaacataaggcttaccctgactgcacgttttttctgggcttccagaatttaaagtgaaaggcagcactcctaagctccgactccgatgcctgctctttgactccacggctttcttgacagaattcaggattgcaatggtgctcagggacatgggcctgtggagaacagccacagccgctgactttctcactgcagaccactgcagaggtgacagtgctgcactgtgtccccgcgtgcctcctcaccggcgcatccctcaccaccctcattcaaacctcccagggcacagtgtggagcggggtggcaggccagacaatgacaatgactttcctgcccacgcttgggaatggcagggacgcctctgagaacatcgccacagagaaccagccctgatgtggcctccaggggctctttacctggctttgggcagcaacctctgcaatggccctgtttcaggtgtaggagatgatactgctacatggccagcacttgccctgggtgtgcagggctggctcacggcaggtgacatggcagggttttcttggccagcaggaactggcactgtttctaaacacagggcaacctggtagagaagataaagagtatgtacattctaatactttttaagttttcaaaaacggatatatgatagttgtacatggttgggggtccatatgagattttgatacatgtggacaacgtaatgatcaaatcagggtaattggcatctccatcacctcaaacgtgagtatcttttctttgtgttgggaacattccaattcttctatgtactttgaaatatacagtaaattgttaaactgtaatatctccactgtactgaatactagaacttatttcttctatctaactgtattttggtacccattaaccaacttctcttcatcccccttctcccaccccttcccagcctctggtaatcaccaaaaatccactctctaactccgtgagatcaacctttttggctcacatatatgaatgagaacatacaatctttgtctttctgtgtttggcttatttcacttaatataatgtcttccaagttcatccatgttgcaacagatgacaagatttcactttttatagatgaaaagtactccactgtatatgcaccccattttctttaccattcatccactgatggacatttgtttccaaattttgctattgtgaacagtgctgcaataaacatgggagtgcaggtatgtcttcgacatcctgatttcctttcttttgactatacagtcagcagcgaggctgctgcctcatatggtacctctacttttagttttttggaacctctatactgttctccatagtggctgttctactttccatccctaccaacagtgtacaagccattccctttctccattttaacactttattggaatagaatcttcacgtactatgagcaagtccataagtaatgtactttgaagccatatcaaccctgggtaagttgaatttccttttcagaaacagaatactatgagaaagctgccacttgtagatgctgtggcatgacagaagagaaaaaggagtatgctactttgtgctcattggtctttcctacaagagatctgcctgcattcctcaggacggtgagcaacagctactcctagaaatggccgtgtgccggtctgctctaaagagggagtgctgggggaagatgcggacacactgacacaccctggcagacctaggatctatagtcaccagctactgctgctgccagctcgcttcctgcaccacgtcctcatggaagggaggtctggagcacagtaaatccatcacagacagaaaggcacgagggagtggccaacaagcagcactctcgaggccttcgggctgactaacctctgatgacggagatcttgagaggtgccagacaaacgacagactggtagcagacagcagactggactgtctggtcacagtgcagtgggccccacacctacctgtgccacaggtgccacctcagcacctccagccgtccc

SEQ ID NO: 9131 - DNA, 35764 bp, Homo sapiens; identical to SEQ ID NO: 7371

SEQ ID NO: 9132 - DNA, 386 bp, Homo sapiens; identical to SEQ ID NO: 7372

SEQ ID NO: 9133 - DNA, 437 bp, Homo sapiens; identical to SEQ ID NO: 7373

SEQ ID NO: 9134 - DNA, 2132 bp, Homo sapiens
tgcacattcatgtgcaagttttgtgtgaacctgtgttttcatttcccttgagtatgtttctaggggtggaattactgactcatatggtaactctgtttaactttttgaggaactgctggactgttttccaaattaacattctcattagtagtgtatgaggagtctaatttgtccaaatcctcaccaacgcttgctgttctctgttcttttgattataaccatcctaatgggtatgaattgattctcattgtggctttggtttgcatttccctgatggctaaaggtgtggagtatcttttcatgtgcttattggccatttgtatatcttctttggagaaatgtctatgcaggtcctttgcccattttaaaattgtattatttatctttttataattgagtcgtaagatttctttgtatacagtagtcctcccttatccagaagggaaatgttccaagaccccagtggaagcctgaaaccctggatagtactgaaccctatatatattgtgctttttctcatacatacttacttatgataaagtttataaaccaaaccctgtatatactgttttgtctcatacatacttacctatgatcaagtttataaattaggcataataagagattaacaacaataactaataataataaaggagaacaattataacaatacatcagcattactactcttgcactttgggggcattataaagtaaaataagggttacttgaacatagcactgagatatcacaacagttgatctgataatcagtatggctactgagggcaggtggtgtatacagcatggatgttctggacaaagggatgatttatgattaaggcaggatggaacaggacagtgggagatttcatcatgctattcagaaaagcgcataatttatgaattgtttatttttagacttttttgtgtcatatgtttggattgatacatgatttgcaaatattttctctcaatttgtgggttgtctttttactttcttggtggtgtcttttgaagaacaaaactttttcattttgatgtagtccaatttattattttgtattgttgttgcttgtactttttgtgccatatccaagaaaccattgctttctccaatatcaagaagatatatacctttgtttttttcttagaattttagagctttagcttttaatccattttgagttaatttttatatatgatgtgaaatagggaaaaatactattaatttttgtttattgatcatatcctgtaatctagctaacttcacttagtagatctatttaatagtaattttgggtaaattttttttaagtagacagtcatgtcactgcaagtgactgcagtttaatgttttcattgataatctgtgtgtcttctatttttcttgccatgttgcattggctaggacctctactacaatgaatgggagagtagtgagaggatactcttgtcctgttcctgagcttagggggaaagtattcagtctttcatcaagtctgatgtaaggtatagggtgttttgggaaaaatatatttaccttctctttccctctctgtttcctttcccctacactgccccttggcatttctggagcttttatttctttatgtaggtccaagtttcagtctggtattatattcccatcgactgaagaatttactgtaagttcttaaagtgcctgtctaatattggttgattctcttagcttttatttctctgagaaagtatttcacctttgttttcgaaagataattttcaaaggatatagaattctgggtttataatttttttttctagtagtactttacaaatatcattccattggccaggcatggtggctcacacctgtaatcccaacactctgggaggccgaggtggatggatcacctggggtcaggagtttgagactagcctggccaacaaggcaaaacctcatctctactaaaaatacaaaaattagccaggcgtggtggtacacacctgtaatcccagctacttgggaggctgaggcaggagaacagcttaaacctgggaggtggaggttgcagtgagctgagatagtgccactgcactccagcctcggcaacagaataagactctgtctccaaaaaaaaaaaaaaaaaaaaa

SEQ ID NO: 9135 - DNA, 104 bp, Homo sapiens
tttttgtatttttagtagagaccgggtttcaccatgttagccaggatggtctcgagctcctgacctcgtgatccacccgccttggcctcccaaagtgctgggat

SEQ ID NO: 9136 - DNA, 3128 bp, Homo sapiens
ctttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaactgaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgcat

SEQ ID NO: 9137 - DNA, 309 bp, Homo sapiens
ctgttttttcagcataatcgaacagcttatgacattgtagcaggaaccattgtggtaaaaagaaaggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgatttt

SEQ ID NO: 9138 - DNA, 1109 bp, Homo sapiens
tctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacagaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaagttggaggaaaaaattactccaattgaatgactgatgtatgtaatcaacttcattgggctggagtaaactagtggaaattagagaagtgttttattggggctttctactgtgagttaattaaaaattgtttttatttgggtcattatgtccaggcttgagtaaccagaacttccggattggcctttctttgtt

SEQ ID NO: 9139 - DNA, 318 bp, Homo sapiens
tatttttttttttttttttttttttttgagatggagtcttgctctgtcacccaggctggaatgcagtggcacaatctcagctcactgcaagctcagcctcccaggttcacgccattctcctgcctcagcctcctgagttactgggactacaggcacccgccaccacgcctggctaattttttgtatttttagtagaggcggggtttcaccatgttagccaggatggtctcaatctcctgacctcgtggtccgcccgcctcagcctcccaaagtgctgggattacaggcttgagccaccacgcccggccggtgtgtatt

SEQ ID NO: 9140 - DNA, 34028 bp, Homo sapiens
aaaggaagctgttgaagttattgaagtacctgttgctatattctaagaaattaaaatgtccagaaatctgcctctgtaagtaaccttttaagatcattcatgccactctgtttctttagtcagtaataatgcagcccatgttctatgccttctatagagaatttcatttaaaatgaaaccactgaaaaatgtagaccaccattttatactaaatggtgagtaaaaggtctgattttatcttgaagaatgaaactaaaattctgggaaaacattagcttatagtaactgtaaacatgcatgaattgttataatgaacaaataatggatcaagtgtgaatggataaacaatttttcccacaaaataattcagtatcattatatgacagccttcaatttgacatttgtggcattagctttaagttgttcttttttttgcaaaaatattgataaaaatatatatacattttttcaaggacctctgttaaattctttgatagtcaagttactcttaccctcctcccgaacaaagaatgtcttgcttactgattactgtaaaagtggtagattccctgagctcagtattcctcatccatgcatcaagactacaaaaaagcacaaactcatacatataaaacatggagaatcttataatactgaaggaaagattacgtgttattccttctatacaacattcacaaaaaggcaaaactataaaatacatcacattatccccatgggtcttggggacaaacaaaacctcaaataatgtcaatgcttatgctgcttgctgtgcccagagtagcagagtctctaacccaggagtcttatgtcctttggcaccatccagaagacagtaacagactaacttgtaagtggggtaaaatcaaatcctagatcctacattgtttgccatcatttttataaactttggaaatcttggaatttttgcaaaatctgtagtctcactcatggttcataagccattatggtgagggagacacttgtgaatagggactgattttataagtgatcagtcacaagtatgttttaaagatatttttaaaaattgaaataatcatctagtaaagcacacagaattaaagtgtgtagcttaatgaacttctgcatatggtatacatccatgtcatcatcacccagatcaaaatatggaaaatttctagctccctagaaggctgtctcatgacccttcttagtgctcttctggccttgatggcataggttagttttgcctgtttttgaatgttgtgtagatggaataatgtgtaatctttccctcagaatatatgagaattctccatgttttacacatactagttctttctgtagctgtgaagtattccattttatgaatttattaccagtatttacccactctactgctgatgaatatttgggttccagtttgggactattataaataaagttgttaggaacatgtacttgttttttggtggacacagcactcatttctgttggatatatacctaggaatggaatttctgggtcatagggatctatgtttagcgttagtggatactgttaaacaattttcaaaagtgactggactaatgtatattcctactatcaatatatgagagttccagttctgtattatcatgaacagttaatcttttttttttttttaagtgtagccattctggtaggtaccgagtgagattttactgtggtagtttttgttttctttttgcattcatgtgataactaatgatattgagcccattttctcatccagtggctattttaatgtcctcttttgtgaaggatctgttcagatcttttgactattcactaatttttatgatgaatttttctccttttgtaatgtaagttgagacgtggataacaagtactcgggtagcttgcacataccactttaccagtttgggaagtatagaaaacatttttagaaataatttcatcaaaagtgctaaagttttttagtcattccatatttaaagagttgagtgtggagatttgctcctctcctgtgctagttttactagtaagagttctaggtttttaaaactgacacctattgttctttttgaaaccaatctcttgaagtttagtggcatacccattcaccaaagtcactggccttttctttgtttacattctctttaaactctcccatatgtttaatcttctgcagtaccattgtatctagttctgtctttttaatagtgcattatcagtaactcactatcaggaaactctttcctaacagtgaatgtttcgtaatatttaggtgtttacttactgttcttttcactctgttgcaaactttttttttttagctctttgtgcaaaatcttaaatctgtttctcatctttacctggctaaacctgtatctccagtcatgaccttttcccagtggagtttaccaccatttctactgacaaagctgccttctgaatgtttttaattctgtgggtagaattctcattttatcattatcttagtcaacgtgggtttaaaatttgaaattatctcttaatttcaaggtacagttagtagaaaaatcagtgaccattcattaagtatcatagtgtgtggtatggcacatgcaatggtccaggtgctgaagactacttcttagaaggattttgtactgtatttgggaagttatgatattatttatgacttattaattagtttttattataaatattcagtgaccatagcctcttcagcattgggtggtaaaggaagtcttcacaaaaggggatagattggagctcatcattaagaatgactaagatttctcttggaagacacagatgggcagaggggcagggatttggattggatcagaaggtgtgtatagtggaagagtaatgggcaagattagattaggactagatctagccagtctcttaagtcttggttcgtcttctttctgaatgctaatgattagaattcatgtttgaatagtactgttgagtttgtaaagcttgtgttagatagacattagtactttaatatttctgtgacttaggaaccatcatctctattttacagaaaagttaataggctttgaaaaagtgatactagtaaagaacagaatctggtgggcacagtggctcaagcctataatgccatcaacttgggagactgagtctggtgtgtttcatttccaggcatatttttattctctgatatcatagatatctataaataacaatttttttgttttaagtttgatatagacatccttagaaaggtatatatatttttacaaattgtttttcttactcatttatttgataaatggacactattctaggtccagggcatccagtggttttgagggcagacgagactacctgcatactaacattgcattggggaaaacaaagtaaataaacaaagttgataatgtaatatcagattagggtaaatgctataaaaaatgaacagggtcaggggatagagaatgttgtgagaatgggctgtcatgctattttcaatcaagtggtcagggaattcctctttcaggaggtgacctttgaacaactgaattaatttgagtgagtatgctgcgttaagttacgggagaagagaatttaggggagagaacatcagatgcaaagacctcacatagaaataaccttagaatacttgagaaatggaaagaagttaagtgtggttaaatgcaattaggtaggataatggttaagaaatgagtaaggagaagccaagggcctgatcatgtatgatattgtattcagaattctggtcttgaagctcctgtctttttgcctccctcttccttaactgtctctctgttgctcatacacatactctctcacacatacgtacactaccctatctagccccccattatattctagtgttcatgaatcagtcagccaggcctgtctcttatctagcctaggaaatgctatgttcatgtctgcctatatatatatttttttgtttgtgtgcctttgcctttgacatttcccatctcatctcagacaaccaaaccatggttttacttcctgacccacatggattttatcatacatccttgatgtagatgcaactgaggtcagcccttcttacagttcatttagtacataacactttatactctgtgacctgttagtgacaattatgctttcattctctttgttatatctctctattttaatgtggccagttttgtttgcctaggaaaaatcatcctacatagggctgggcaagacaaggcacaaggcatatccatacataaggaggatatctttacttccctgtacccttccccaccatggttccagcatagaaggctggatagctgccagtagttgatcggcatccagaactgtatctggtactttagtaggctctcagtaagtgtattttgaatgaatcagtttattgactgttgagattaaaccctacttggcataactttttttaaaaagccccatcatggctattcacaatacatgggatgtaacaaagaatcaataattatttgttgagtgtatgtcagttttactttactctgtgtttacattatctttatttactttatgttattgtctgggctttagctgagcacatacattcttttctggaaagatgcaccccagtccagaataatattgatgctagaatttttcaaagacaaagctatagcttttggcaattgtaggcacaagaaaggaagcatcttttgttacaccatttttccaaacgttattcttgttactttagtaggtatttatcgtctgtggttggctgtgcagcgatctgcaggagatcttacacattctttttattctttatttagaaatgggatctcactatgttgctcagactggacgtgattgaactcctgggctcaagtgagtctcccgaataactgggattacaggtgtgtgccactgagcctggtttttaccagcttctatcggtggagtgcctgtcacttccacctgtcatcatcaggagcttcttaatggtgcagaacagtggtttacctggagcaagctcattaaccaatataaaatatcacttaaaataagccgataggaattataaaattagaaactgacccttttaaaatgaatttattctctttaaatttattcaacatacttagttttacaaatagatacttgccattttactggcagttataatgatttatttgagggtttggtacatcttatacaaccgtgaatacaatttgcatctaataatgtgacttcagtagtatcatgatttttgtccaaaccttctcagtctgggaaacatttaaagagaataatgaccttagagaagagctggatttcttttaagacttctattcagatcaggacacaatcacgttcaaaattgacatagcatgtaacatggatttcagtgaagaaaagtacttcagaatcaaattttagaagagtgttttagggtttagtggcctaatcaaagggagtccagaagctatttttggataatacataggaggtagagcaacctggttttgcctctggttatcatttgacattgccagtgtcttacttgttcatattatggggaaggaatcgagtggtcacagaacttttggagaaaatttatcaattttttgtttactttgtaatgcttttctgttcttatttaataaaatatgcctttcgattatattaatttaaatttgtatatattgaattgatttaaactaggatcctttccccctttctctttcaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccaggtaggtcttattcctgagaagaatttggaaaaacaaaaacaaaaaacctctcttcctgatatgcatgtaactagatttagtaatgaaaaggttgtattagctttgtgtttccatcttaaatattctaatcttggaagggctattggattttgagtttagctttttatatgtaggtgatacaattctcaggtggcttactctaattcattattcactgtaagcacccatatatctactctgccttttcctgtggatgacctgtctctggtttatttaagccctaagctcacctgactggtgggcactagagatgggactggcccccaggcctgggccagtgctctagctagttttctgatcttccctaaggtgggactgatccagttttagaaggatatgtaagatttggggccaggtacggtggctcatgcctgtagtcctggtactttggaaggctgaggcgggaggatcatttgagtccaggaggatcacttgagttcgaggctgcagtaagctatgatctcgcctctgtcctccagcttgggtgacagggcgagatcacatctctaaaaataaatgaatacgatttgggcatgcagaaagataaaggataaagcattgaaggcaccaaggaaaaaacaggggtgaatagctcaattccaccctttcccgtgctgcatctccgtgactcaacagcattgttattacgttaaaaactaatagtaaagggacagccaatgctaacaagggtttggggtaataaccccaactccagggattgcccagtcttgattttgtctcctgtttcttggaggtaaggaaatgtcattcttgaactgggacatgggcaaggtccgctcccactctgtccccagaactgagaactcacctgatgtcagacagcagagcgctgagggggaaaacctgcctaggacagcaggcttccagggtgcgctgccattagagccccagagtggggcggacagggcctcatcccacttcatgccagcaggttctgtggacaaaggtggcaggaagaaaagccccagccaggctgagcaagtagggagtgtgtgtgtgtgtgtgtgtgtgtgtgtgtaaagagagagaaagaccgtttattaatttattaatacagataatattaatagtattaatattaatatagatattatatattaatatttattaatgtagataataaacagagccagagagaatgaaagaggaggtgggggtggggggtccactcctctccccaaccaaaccaacctgcggtaagggcagagggaggaaaagacacagggcactgtctgtgtgtgtgttgagtggggggtccctcacatttgagatttatcttttatttctctgtgactgaagctgagccacttccgatttgtatcaggaggaaatgtgctgcttatgcattcgtaattagacccaggtaattcactctttaataatcagcaggcttctcccaccagcccactaaacctccccctcctgcctgctcgtttctattttcatccctgtcccctcccaggtggggatcccttaaagaggcccggctggtttgttatccttttcctttctttccaaatggtcctactggggccctcgcgggccggcctttcccttcattgtgattcagagtgaggttctgaaccagggctctaaggaaccagagaagccgattatgggaaagggcattgtttgaggagctccgatggcgagcaagcccagcccactctccctctggctcagcagagcccagccggaccctcccaccgcggggaggagaccatcaccaggaagccaaaaatgatgagagggttctcttcctcctgtctctcaagtgggcacagggaggatagaaaattgtcctttgagatgttattgccgctgtcattgtgaataaaggcctagggctccaggactcccaactgagtacactgcctcggtcccctccagcccccagcccacctctcatccagtgcccaggcctctgcagaggggactgaagggagcaagatggatgaggcacttaaggaatgagggcccaggagacaggggagaaaaattaaaatgtaaattacttttgctgttttgttttatactgtttctttaaaaatattattctcattacaaaagtaaaccatggtcactggagaaatttccaaaaacctcagcattcagaaaagaagaaaatgaaaatcactcttaatccagccacctagagataattactaggaggtatttgcttgtggttctctttacatatttatataaatcttaatccacaaactcaagtgggtaagaaatgaaagattactagtcagtctctgttaggagccccctgtccctcattcctcagaggtggtagaaatctcagctcagttctgagtcccacagttctgagtcccacacccactttactgaccctgtgataaattctgcaggcttaaagcaggcaatcatcccacccacagccctctctgccttcactgacgtccaccaaacctctgttgtctatctgcttcctaaacgtcagtcctgtgggtcgctgctgcatggaacctcattcccatcaaaaagacagcctcagaacgcctgcttgcctctttcatgcccttctcagagcactgactcagaagcccttctgtctccaaatcattttggagctggaggcagcttgctgtggcccctcatcacttcatgtacactgaggtgaacttgcaggcatgtatgaggtgagcttgcaggaatgatcttagggcttctgcctccttagggctccttaagaaaggtatttaccatctccctctgcaccccaatcccccgaactatctggtcttctgtcatctctctcaaggcagaacactcctctaccccctctcagagacctactcacatctaaggtctccttgtgtccccatgaactctcttctcctcacctcctgctctaccctgccccaagatcagggatattcttttctaacttcagagatgggaaaatgtgctcttatgcaggattgccatataaagttgagcagtgtgtgcactgcacaacagggaagtttaacatgcccagggaaatggcacctttttataatttgcccaaaggtaccatgtgtgtgagccacaatgctgcccttactcatcatgtcttgttccaaacctatacctgggccaagattttgaaactcaaaagccaataatttgactcttttgttagccgagttctgcaatgtcctcccttccctgaagcaattaatattgagcagtctggctgctgtctggctgcaaggaaggaccacaggagtcaggaaatgcagggggatgccttggttaatacttgacaatagcatgcccaaatgtatatgcccatttgcagctccaaatgctaggttcaaatctttggggttggggggcaaaacttgaatttttaaaagcatgccaagtaattctgaaggggttgggagagaattcccatgaaaagaaatcaagaccagtccctggaggactgctgtccccagcccttcagctcccattggggagctgtgggtgaggctgcttttctcgcctggatgggtgaattcaagggtgggagggccaaggctggatggcggcttttcatatcttaaaatgccctgagcaacctcgagtatcttcttgttttccctgtttggttccagctaagatgttgagaccatccacttactagtgaagcccagcaccacttctgggaggagtgtcatcttaaaggctttctccaagaaggggccagatgactccaagccatccagtctacttctcccatccacaggcagctcaaaagcagcctcctagtgggagggggtgggagaagccccttccccagcagaactggggtacagagtaccccatatgcctccccaaaggaaggcttcaggatggagacaacctcatgtctgacctgggagcctgagaggagcatgttgaatttctattgcctcagcataaaatggcaatgctaatgtagtttccaatttaggttttaaaatgccactttaaaggacagcttcagttctctcacttaaaactttttaaaaataatcacatttcctcatgaatcaggacatgtgcatatttgtcccttcttccccatcaaggactcacagagcataaggcatcctcttccacagactttagatgaccactgtgcacctcttctttggacagggggctttctctgccccaaccccacatccatagccccttctgcctgggtccactgagcaaccagtgacacttctgccacactgcgtgagagacttgctgcccagtgacagagggggagggaggactgggaaagaaataagagctgcccaggcagcagccaagggcaacgtttgaagcagggggtgcttggttgtagcgagggacttatccagacaagagaatggagatccctcgtagttttatcaaaaagaaaccaggtagttgggttttcttttagaactttgggaggaaaagaaaacataatttcacaccctgaagaaatatgtgcctgaattttgtaaacttggattttcttcctcttcctaattaagggtagaagtcctccctaccctttcagtgcatgtggggggcagggatgggcataaagagtgaacgttgtccaaaggatgtctctcctatcccaggctcccattaatctgggaagcaacctcaggatttgtgcccaggaagacagagcccctcataggaaagagctttctctagagaactggatttgtagggttgacctggtgtttggggagggatggggtgagtaggagggggtgcctgtctttgcagggccaggagtaatcccctgagagggaagtcaggcttctagctgcccacctaggtccccagctcaggagcagaatctacaggcaaagagctcaagcctgcatgacctgttgccggctctcctagccccagtccttcatgggctggcccaaactgctgactcctaagaatgcagagagctaaagcctacacctcctgctgcccgctctcccagcttcagcccgccgcaggctggcccagaccgctgactcctgaggatgcagagagaaggcaggttcccagtcctagagcttattgctgactcagaccaagtctttctagctggtcctgccctcagccatgggtaggggttacaagtcaacggggccattccctgacctcccaaccggcctgctcctgaaccctaggaaggtagatcccaatggcccttccctgtccttcctttgtggccaaaagccaatctggatagttttgttttgttttgtttcatattttgaatctttgtcagatttttaaacttttcaattcattttgattccatttttcattctaaataaatattcactttaaaacctaattatttgctctttctcagagagatcccccaagatgtaaaagttccagattccaaaaaacctagaaccacccttaaggatggaccacgaggtgagtgaaaggcaagaggctgctatagtctcagtgtccagcaatggggctctgagcctgggcagtagccagccctgtggaaatattgatggcaaggagagggagaaggcccagcagagacgacagcccaggacacacgtgggcctgacattgctgaccacagacatgaagctctagccacaaggggggggtctgcttgacaccctgggctcccacttcagcccagactcagaggcctaaccccaagaatgaggttcactcattcactcttaccctgggaagactgaatatgaagcacacagttaagaccaacagtaatcaggtgaggactgcctgggtctcttccactaaagagagggcaaaaaggcagggttagttgggaccaaaggctgggagagggggcttcctcggagggctgagtcttgctgggacttcaaccctggcacccgccccttcctctaggatctgacagccttttgcaaaggctcaccagccccaacctcagcagaggaaagacgactccatgcttggctagcaagggcaacagtgccaccagcttcatatgtcccacctggcagggggctcctaacaggtgaggtttgcttaggaattccttacggcctgactgagacactttcagcttgaggctcttcttaccgaatcctttcttccctctctcctctcaggggtcagagcagtactgtgacctgaagctctccctgctgcctcttcttcgtgccccttttttacccatcacagctatttcccctaatacatcttctgcatgtgcttcttggaggacctgagatgacactgagccagactgaatttttcttcttgccataatcagaataattaaataagattaaaagacagaaactttgtcgttgtgtgattcatgatgtttaatgctgtgcccatgcactacttaaagtaatatggcatcccacttgaagtattcttgccaaattttagaaaatgcaatcctagacaaaatcaaactttttctgatggagttcttttgccctggcctcactaccaagtcccagaccttttcatgaagcagtcctgcatcagtgccacagatgagtcggggcctctgaagtgactaaacacacctgctccctgccttgctacctgtctccatttctgggactaaggcactctttctggctcccagtctctccataagtataaccacaaaggccaggcaccctatcctggaagcctagggacagggacgtgaggatgttagccagaccaccaggggcccctgagcctggcaactgatcccaaacaacagtcctgttcccagtctttggccatatactggctctatcccagctttagcctccttgccagtacttggccagagtgatggctcatcccttagcatgcagtgaccccaccgtgaccccatccaacacacctagttgagcccaggcagcaggaggaatgtggtttcaccaccatgcaaacctctgcctttcccagagaaagcaagatgattgggtccagggggtgactatcagtctatcaatcccaggatcctgcaagccttgggtcgccataacctgcttggcttgaggttataccactaaagggacctggagaggcagatgaggtcacatgtcattgggaccatagaaaaaaatgttgaggtgctaaccaatgagtggtgagacctgattcaaaaataaatggcacaacattcaccagcctggtgaatcttgaaactgactccatcccatcatctgatctgaccagagaccagcaagctgacaggaccacgggacagaactggagacaccctttctgggataggagacaaagccctttcagagctctctccttgcagaatcatttctccctcacaccccatcgtctctccagttaccccactccactaaccaaactgcagccattttgaaagccctggcaagaccattctccaagcctcctacaggttattctcattaggaaagctgcttcattccagagtctgggcttgggctacttgctatttacttcttaaaatggttattgtaggctgggcatggtggctcacacctgtaatcctagcacttatagaggcggaggcaggcgaatcacctgaggtcaggagttcaagaccagcctgacaaatatggtgaaaccccatctctactaaaaatacaaaaaaattagctgggtatggtggctggtgcctgtaatcccggctacttgggaggctgaggcaggagaattgctttgaacccgggaggcgaaggttgcagtgagccgagatcgtgccactgcactctagcctgggcgacagagcgggactccatctccaaaaaacaaaaaatggtcattctaaaatgtaaccttaaagtcaccaaccactatggttgccaaagtcatctaaaacgagcaaacagaaagccactaacaggggcaatgatttaaaaaacaaacaaaacagttttgcaagcaagggcatcatcagcattcacagaggaagtggccatcccattctccagcagactaacacccacacagggaaaacccacaccagccaatcttcaattgtctgaactccaatcttcagacagcaatttttcacctttgatcttcacccccagcttctgcgtgacgctgagtagtttaataataattcccttggcgtgtggaagaaacagaaatagctccaccaggcaccacaggcctgcgcagcacagtttatgaaatcctggggctctaatgctcccagtctcctaagtttccattaaacagctgccaaatggctctcgctggcaggaaaggcacccttgcctcgcctcccttggtttctccgcagacaggtcaggagggaagaaacatgtgtcactcaacaactacgtaatgggaaagaggttgccctgaggtccccccctgtgacctctgcctgtcaaagccaacctctaagcccctttttataatcttttccaaagacttaaatgtatgggtacacaaagctcccttaatggaaggtcgctctggcttgtataaagagctgtgtaaacttcatctctgcatttactcagtaccagccttgtttaatttcctgcccggggatgtgcagggaacgtgactgccctctcagggccctgaacatctttcagaaaagaaacagtaccctccctacttcagggccccccaaaaagcaagacacctcctccaactgtactaaaagggaaggcagtttgaccacatgctctctgttgagtttctctttagaaaaggcagcttcagactgagtggacaagcacagaccacagctggagggtcccctacaccataaccagctatgtgatcttggcaagtgacaccacttcctggggttctggctttctcctttagaaaatgaggggatagatgtgcctatcacaggttgctgtgcggagaaagatgaatgctaagcccccgcctagtgctcagcttgtggtaagagggccaggaatggtagctactagaatcattctgccatggcagaaggttcattatagtggctaagtgcatggactctggagccccacttcccacatccgagctccagcttcttcattcacaggtgggagaccttgcatgtgtcatttctataaaatgccgcatgggaacagcagcagctgtggggaaggaatgagcagtgttggggacatcaggttcaaagatttccctgcccaccaccactaccatccctgtttcaccaccatccccgtcctgccactatgaccagcgaagctgcagagaccttccatccacaccaaaccctttgcagacaccctgctccacaccatttcctggataatcacagcctgtttccagaggaggaccagaaaacacttatttaccattgcccctcattttatagcccaaaaggctgaggcctgccccagattccacttacagcctcccaaatgagctgccttgtgtcagtaagcccccctcctgggttcatacctggggttatggtggacctgagagaaagtgggggaggtaggccatgccacttcccatatagatcccaggaggaaattccaggccaaatcccaaactgagctacccaagtcccgcattcatgccttcccaggacccaggaagttactgacagcaggagcgtcacctccatcccaaccccctccatccaactcatgagctgagtctccccctggctgaaagtcctggtgaggaggcctgttctggcttcacataatgttctctagcgtgctgctggccgagaaaaatgctgtctgaaacaggtcaggtcttcagagaaagggactccccccatctcctgagtggcccactgccactgctgctgctatatcactgatacatggtggctgtcctgtgctaacacggataagccctggcccctctcagagccaactctgccatctggaaaatgaggcattgatggcagccatgtggaggggctcagcatcctgcaccctggaagcagaccaggcagccctctaggaccaaggggggctctgtctgggatggtgattggtagatggggcagtgctgaatactgtcaagccctgctaaaacccccacaggtccatctatgggactaagtgaaaaacacccaagagggcatttttgtacctcatttggcaaacactgtagagtcaggacttggaaccacagtttcaacttcgacaaagagctcacggaggtgattctgccgggctgagcagggatttgtgggtatgagctctggccaaggtctgccttgcacaccctgattgttcttgttatgctggtggccaggcatgaggtgcagtgggaagagagaataactaactcatctttctactggctctctcagccaatgtcaccaagctctccccatgtattgcacccctgaatgggagatgaggaaaagaggagaaagacatggatgtgaacttggttgaccctttgagggtctctgacaaatgagcagacaacagggctgggactagggtgaggggtgaggcatctaggggcaaaactgaaggagacacctactcccaaccctgcacttgcagactctgagagcgagtgtctcattcagtattgtgctctagacttctcacccacctccccctaattctggccctgaaagaaaatgacaggccagaggtgaggggtgggtgcttgttgagaagtgcaggggctgtggtggtccagggtggttgttcccactctagtctgggggtcctggaagactttgcagaggaagtgagcagttcagactcctgggaaaggagacacctccccactcaatccaactgattgcacacctctgtcctggccacctcgcctttccagacctgccaagggcaggggggcaactgccagcgccatgtcctccttttgcccctctgtgcccaggcagaataggcaaaagggagctgaacattcttgcacacggtgcgggatgcacacagaccggcaggacgcagccggagaggacacggggcccacagaatcagtcctggcttgaacatgcttgtctgggagcgcgtctgcacacccttggaggtggtgtgcccggcctgcgctacccagcagccagtgggcactcggaacaaaccaggccatgcctggagggagcctgtcaaggaggataatgaacgcaggtgtgcacgctcagctgagctttgtctctgagttggtttgcttacctcaacggtttgtccctgtttggcgtgtggctctgttcataggtctgtaactgtgtctttgcccgtcagtcttcctgtgaccctgtgcttttctctctttctctctctctctctgtccctgtctctgtccctctgtccctgagtgatgtgaggccgggctgggggcagtcgcagccgcgtcctctcttgccctcattggttcgcagccgctcccccgggcagccgccgccagtcccgcccctcccccgaacccccgcccgggacacgagcgcgctcagagccgccagaaagctcagtctcctgctcaaaacaggagcgcagcagccggagggagtggggacaagctcgctgaacactgggcgtctcgacagggaccagagcctgcaggactgttccgagacgctgcggtggcggcggcgccggaggacgcggaggactccctggccacccgccctccgtgcgctctgccaccgggcgctcagcagagaccccgggctgcggctgcacttgctgagtgcctctccccgccgccgcagcccagaggcgcccagcacctggagctcactggagctgagggtccgagctgagcgggctgttgtaaagccgaaaggcgagtcagtgactgggacctctgtcctggtggcgacggagagaaacagtgagcccgaggggcgcgggcacagaactgtccagctccgagaactggggtccgccagccggcggggaaagcagctgagcgcggaggcgagtgagcggacgcgtcccggggtctttgcagtccccgccggccccaaggcaccgactctcggtcagttgggcgcggcagggcgggaggggcgcgccatggaggcgccgggtcgcgccagtatgctccaggccaagtgaagcggtccggctggggtcggcgggacccgcgggccatgtacggcgacatattcaacgccacgggcggccccgaggcggcggtaggcagcgcgctggccccaggagccacggtcaaggcagaaggcgctttgccgctggagctggccactgcgcgcggtatgagggacggcgcggccacaaagcccgacctgcccacctacctgctgctcttcttcctgctgctgctctcggtggcgctcgtcgtcctcttcatcggttgccagctgcgccattcggccttcgccgcgctgccccacgaccgctcgctgcgcgacgcccgcgcgccctggaagacgcggccggtgtagcttgggactgagccacggccgccgggcgccccgtcccgacctagccaagagcagccagcttgagcctggtagggagggcacgacaccggggatcgctggcccctgggaacacggtgccctgacccaaagacccttcctgaactagagtggcaacccgagaggaaagggagaccgaggcgtcgggagcctgtgtagggtctcgatcccagtacctgtaggtaccgtgattctgatcccctggccaaatctttcttcctctggacagagggtccagtcgggaaaccttcccgaaagacggcggtcgggtcgggaaaccttcctgaaagacggcgcgccagcccgtcttgcttgctcgccgcctgctgacttccttactttgcacacggaaggggcaggaaccgcaagcgtgcaactagcctggagctacccgtctggactcgcaggccctgtggctgtttcccacagctgctacggcctctcttgctccttgacaccgaggaggaccccactaggatccgagcgtcgtgaactcacctgaactttggaaggttggcactggggggccgcatccccctgggaaatgactgaacgcggggtttcagtgggtcccgcctgggtctaaggacccagtttcttctgtgagcacgggcagtgggaggccggtggaaaggcgcaggggcccacctacgcgtctcacatcttcaggggcgcatttctacaataaaaactcacccaattagacctagcgctgagaacgtgctggtaattgtttgcgccgctttggaaaaggggataagggtagatcgatcccgagcaggagacccaagcgagagacacctccccgcccaggacattttgatgatactacctcctcttcggctttttcccagggtcggtcaattacttccttggggaagtttttttttcaggatggtctccagggaaaattgctgcctgacctgctgaataaattcccattaacagggctcctggggaccctttctgcagggcagttccttccacctggcatcttcccttttgctctgagctttcctgggcctgaagcccctgaagagccctatctggaccagaaccgtctggtgaaggaagagcctgaagatcaggtggtggggcagctgcccagcacttcctcccaaaggagatgggggcctgccctggagaacctggcaggagggaaatggatgcataaacccagttaaggggaaatcaacttcaaagaacttgagagggactaggaaggcttgtaataaccttaaccaaagttaacccaattctagggagtctttttacggggctttaaaatagtttcaggagtcacctggctcaatggagcactagagcttagagaaggtttgactgaaaaagaatttgacagactgtctaatccagtcattctaacacatgctagggtcacttgggcttttggcaatctttagaaaactaaggactcttggccctggccaaatgcatacaggcacaaaattctgcaacaattctatgagttctgacactgaaactggttcctgagaccagactgaggttgaggaagagagactggccagggctcctgaggcccagcccagcccagcccagcccaccacttctcctcagtcagtatccaagattccctcctggcttctatcccaggaagcactggagacgaagcatagaaaccagaaaagcctccctgggcttgattcttcacgccttccagaactaatacccaccaggtcctaacgatgccaattctatgatcacctcacacagcatttcagtttagtcttcagaaaggtagccaaacctctgcagcctataataaaggtaacccaagctaatctgcatgaaccttggactagacggaaataaatgtgagaaatatgagggcccctggctagcatacaaaatcacatgctgctgaaatgggggacccttcagccttggtctgagggcttctgagggggtagggggacccttcagccttggtctgagggcttgtgacaggtaggagactaatgtagaggcagagtatctctccaccacatgtcctgatggccagatctgaaggtagtatgcagagtggtcaaacgtacaagctctggagttcaaatgcctggctttaaatcccagctccacctctcactagctgtatggccttgtgcaaataacctatctgagcctatttcctcatctgcaaaatgggcattatatcaactagctctacaagtttgaataatagagtataaccaaagttattataaccaataacaacatgctagcaataatgcttgcagaaaatgagcgtccaaactatagctatttgtaaaactgagctataggcgtgaagcagcactgctgctgcgaggagaccccaccaacaggatgtgctctcactacggcccactgtctcctgtgaccacaaacaaatgcaaggactggttccttcatgggagaacatgagtagatgactggcttaggattcacctgtagttcctgggccagaatcagctcaagccagagtaatccaggaggcttttgggctctctctgatgtctctacagggttgcagtggcctcagccacttaagccaaaggcttggccacttcaaatgaatagacactttgggaataagtttctgggtaattgagcctgcatagacctggaatctagaaagcacacagggtcagtaaaggtattatctgccagcactgtgaacccgagtaacttggttctcttttctaggatagtattagactgaggggtaatgggttcttcctcatgttgaacccagccccagactctcttctgggaagcagggatgtggctgaattcagatctgtcctctacaatatttagaataagtggactacaacatggtgattggatatttaggtggtgttaaaattgaatgcatatgtcttcccaaaattcatatgttgaagccctaacccccagagtggctgtatttagagtaagaaagtaaagttatatgaaatcataagggtggagccctgttctgataggattagtgtccttgtgggaccacagattgctctcaactctggccaggcgcaggcacggagaaaaggccatgtgaggacacggtgagaagatggttatctgcaaactaggaagagggccctcactagaaaccgactcagccggaactcgaatcttggaggacttctagcttacggaactgtgagaaaataaatttctgtttaagccacccagtctatggaagcagcccaaactaagagagatgactgtctgggtgtagacctgtgcatacacatcctcctgccctttgccctcccaccagttccaagatgtcttgaaaccacctttggagagcagggcatggcaggctaaaaacaggaatagggcccatgtcacaggtgtttgggttcctctgctataaccagccacagtgagcagccagaagggttgaggttaacgcatttttgttggtgggggttgggggagaggctggagatcacggtggggaggtagctgcagatgctaggagtcaaggagaggtagcatagtggtgaccaagagtctgagttctggagccaatgacctgagcttgatcatccactccatgccttcatcgttatttctgtatttctgatagcccgtttcatcatctgtagaatagagatgacaataccttcttcaaaggattttcaatatggagtgaaacattatcagtaaagtgttcagctcatgtttgctatgtagtaaatgccctgaatgtgagctatcattattaaccaggatggccatttcagaagtgcatgcagtggtacaaactactttttgtcagtgacctgtcctttttcagccatgtgctatcaggaaacagtaaagaggtctgtacttcccaacaggtatgcccagagttggaggacagctattctgggtcttttctcactttgcaccttccccctaaactatctcattcgctctcatggcttcagttgcttttcagatgactctctccacactatccctgagcccactcaacacctccatttgggtatctcatgggaaacttcgaactcaacaagcctaaaactcatctgtctaaattagatcctccttcagtcttcatctgaatagactgcaccagcgtatggctgcccaaagtaaaaaatgcatggtggtcattcttgaccctaaactcttcctcatccttcaatatgtaactcatcaccccctaggcaccactctactccatctactcctgtctatgtccaccatcacaaccctaactcaaagccctacttccatttttgtctctcctcactcaataaacacatctgccgccagccccagcatatacaccaatggcttctctttgctctcaggattaaacacaaaagcctaataaggaccagaatcaactggtcccaccagcctcatcttctctcactcctcttacactccagtggcctttcaatccctacctctgcctaagctgtttgtttctcctccttcctctggctgatgccttctcatccttcaggtctccagttaaatgtttcttcctcaaaaaggacttgcctaaatcctcaggtaagattaatcctctcatgaccccatattgcctccccaatcacagctactaaataactgcataattagtagcccaatgcttcttcccactagtaacatgtaagttgtatgaacagagaacagggacaacatgtgtcctgttcactgctgtttcccaatgcctagcatagttttaaacagaaaataggcaataaatatttattgaatgaaatacagagggaaaacagagctaaagtaaatttaaaaggtgtatttacatcggagcacatatcctttgattttccaccttaaactaaccttgtatcaggtgaaatattgagttgaacactcctttattgattggtcttccaagtggctggtttcctagcggtggtaatccaaagttcttagcaactaacgtttcccgtctccacctgtgtaacacttcagttattactatatctcctgcagagactaaagaacaagcaatttaatagaagtttgtacctttagctatttctgcttgaattattcattttctgcagaaaagcacagatcattgcagtaacattcacatgccttctgaattgccttgaataagaactggttaaatcactgcttcacgtaacaacttcctcatcttcctggacttcgatcaaagattatttactcagtgaaaccttccctggctactatatctaaaattataattccaccttgttccccaaccctggtatattcctttcctgctttatttttttctctttggaacttactagtaaacacaccatatattttatttaccttgtttgctgtcttcattaaccagaatgaagatccttaagggaaagaatttttgttttaaccactcttattcctcagcctgacatctaacaagccctcaaatattagtcaaatgaatgaacaagctcatacggctcagggccagaaaaaataaaaatattcagaaacacagaagtagagtctatagtttaaaataaccctcatttgtgggtcctgcttctccaccctccaaaactgattaacctaatgaactcggaactactctgttacagcttcactttccatgaggacaagaacaatgattccagccctactgccctgcctaccataaagttggacctgtgttaatcactcaattggcaagtaagtattaattaggttacagtccaaactgctataacaaagccatccgccacgcaagtttctttctcacagtactctttcaggtgtagcacagtactctttcaggggtagcacaactgtcatcctcatccctcggcttccatgtccacttcaaggtatctatgctagatcctgccttcatatctgcattccagccactgagaaggggaaaagagcaaggggtgcattcctcttccagatataatgcagaagtggtgcctatcacttctgctaatatcctactggccaagcttagtcacatgaccatacctagctgaaaaaaagctaggaaacgtggtatccagctggacacaggtgttctgcaatgaaagggcaaatgggcattggtaagcttacagcaggttattaaacagacaataaaaggaaaggaccttcttttcatatgaacatcatctctccagccttactagttacacattactagtttgtgcctgcattcttcaccttcactgaattcactaacttggtctaaacaattctaagttaatgaaaaccacatttcacaaaattttatgtaaacaaaaggcaattagggaaagtttactgttaattacacttctgaactaatgttggcaaaactataaagtggacaaaatctaaaaaaccctctagaccctgttgtttcttcttcctgaacttctccccctacatcacccacacacactcttcagcaaaattaatcttttattctgaagcacaaatatggttcatgtatttgttttatcatacgttctctctctcaaaggtattccttgctcccactcccacctgagtgcaatgaaaggcttgccccttatgtacaacagttagggaaggatattatggggtctaaaccagggcactaaaatcacactacaaaatttgtaacaccccagcttctgtaagctgtgtaattaaaagtacactttttggggttattttctcttgtcaagcgtatcaaggaaactatgcccttcctactttctttgggaaaatattaaatgttaacaggttaaagctctaacttgactattaattttgcaggttctacaagcaacaattccaagaatttgataactttggagcaaaagtccaaaagttcaaagagaaaggatatgagtgctttcttagctgaatttccccttcttctcaattatactttagccagctcccacaataccccaccccacatcaaaccacttctcaggcataaagagagctaataaaacattgagctagaagcaattcaactaagaagtaaatattacattatttaaaaggtaaattctaatacttaaaaaattcacttcttgcttcagtactctcattcattcaacaaatattggtatgcttacttataacatatcaagaactgttctagcagtggcaacacaggtctgtcctcacagatcttacattcccatgaggtaagacagtcaataaacagggtaaagaaatatatatgttggatggtgataaacgctatgcagaatgaaaggctttcttaggtacaaagaactcaagaaacactttagaaccaaaccaatttctctgagaaccctttcaaaaagagctagagctccatctataatcagcaaagtatctgtcaaagaaagccaaggatcaatgtacagtgactaccagaacaggttagaagggcacactcataaacctttgctactggtttgggggtttcagttttaacttttctgttaaaattctcagcatttatctcaaatgaaagtattatttaaaatgaaataatgaaggaggtttattagatgggaaggggtaactgattaagacaaagtataaggatcttttcaaaatccatctctaaacatcaataaactgcctcagaaaatctctcactaggaattatacacacacccatttgatataatatggataagtcttcaccaccagtctaaatccctcttcccacctcccatccaacatacgttaacatggagatggttaagcaagctgcccatagctcttctttgaattttccctatagccccattaccctttttttaaacagaaaaactgatttagatagaaagaacaagttttgtttttgcaaagcttatgatagacttacaaactcaatgacaaaaatcagtaatatttaaaatgttaaatgggaagggtgttttaaaaatgcttccttctttcaatcataaatactacagagctctaaataaatcttccttataagcattgctgcagtctactgacaatcttaaaaatgtttataaaacgatagctgcatcaaaactgctgtaatacaaaatagtattagccactgtcccaacccctcatcacctgaactgttttggctacagcaacctgaaaactaattatcttaaacccaagagaagccaacatcctcttagtgctcactgaaccttcttccgctaggacaagtgtgcttttttaaaaaatacacttctaaaacaaccagtgatgttgctacaaaataccttacaaaatgccttttaagtaaaaagacataggaaggaactgattctcagaaattggtaggaatgtccaatcttttggcttccctaggccacagtgaagtataattatcttgggccacacataaaacacactaacactaacgatagctgatgagctaaaaaaaagaaaaaaaactcgcaaaacaatctcataatgctttaagaaaatttaccaatttgtgttgggccgtattcaaagctgtcctggaccacatgcagcccatgtgtgcaggctggacaagcttgaatagagtcttttttatctattaaaaaaaaaaaaaaaaaaaaaaagaacaagtgcttttatctttatcctttagggttaatatgtagtttgggtttttctacatttctggcaagggcacatgatttttcaccattccttttttttttttttttttttttttgagacgcagtatcgcttgttgcccaggctgcagtacaatggcatgatcttggctcagtgcaacctccacctcctgggttcgagcgattctcctgtcttcagcctcccaagtagctgggattacaggcacgcgccaccacacccggctaatttttggatttttagtagagacggggtttcaccatgttggccaggcttctcttgaattcctgaccttaggtgatccacctgcctcagcctcccaaaaagctgggattacaggcctgagccactgtgcctcgctcaccattcctttctaattagaatgagtttgcatgtcttgtatatgtaattcagaggttggtaaaagtgtgcaacacagtgacaatgatgcaaagtcagtctgtgatttaaaattttttcaaaaaagaagacaaaaggaaataaaaaattgtaaattcacaaagtggatcatcaaaggttgatacaccgaggtcaagcaacataagaagtaattattctgaatcaaagaactagtggaaatgtaaaagatagtaacaattttaatatttgagttcttatgttctaagtactgttctaaatactgtatttgtattacacttcaattaatcttccctcaaatccttcctatgaagtagacttttcctttacaggtcaggaaagtgaggcatagagtggttaagcaacttgtctaagctatgaggcccatgactcaaacgcaggcaggccaactccagagccaaaacaaaaaaagacacattaagcaggtttgaggtttattaaagtaaagaattagcaaacaatatgcaaaaacaaagttcttaagagttatggctttcaaaagcacaatatagtaaaacctaatacattttcataagtatcaaaataacagaattgaagcatgttgctagaatttcagcttctacaacataaacagaagcacaacaaatacaaataagcagcagacctacagtgcagccactagcttggtcttcattatctgtatatgaaatatctttttaagaaaatgtgggcaggtagatacaaacattctatttccatgattacaatcctcttcgattttaaaataagtgaatttcaaaatacaacttacgccaaccatatttaaaaaaaaaatcacttgcctaaccattatcttctagagttcctatagttaaaatactttatgaataaatcaatgcaacatcatcttcaatgatattagaagggaaaatctgaccctaaaagattttttttttttttccacaaagaacttgggattctttggccttactggagttttgttatagctaacaccagtctgtattaattaagaaggcactattaatgagggacggaaaaatctacctgtacacaaaattctgtactttaacagcatcttcaaataaacctttaaaggataatggtttacgatcattttaagaattttaagaactgagttatttggacaagaaccatacaaacctttttcactctgccatgaatgatcgaagaatcctgctctaggactggatcttttcagagaaaataacttatcacctgttttactgcagttgctactagcaattattatatagcatgtgctcttcaaaacagaaataaaaattgatgtgtgaaatccctttcattggttttggtaaaccatccaattttgggctgtcatttcaattataatacagttgtattttaagagagaagataatccaatataacaaaggcttgataaatattgtcactctgtaatcaggacatactaaactgtaattcagcgaattccaaagaactttccaggtttctgtccagcaggtagaattctttgtttatgcagaagaaatgccttcaattctcacattcgattcaggcatcttgtgtgataagaaaagctcctaagaatcttacttatatcaatgagaaaaatgctgctgctctgggagacctgagattactccccaaaaagctgccctaataatatctgataccacctataaaccaccacttaggaaaactctctccataaaaatcaccaaacacttctaaaaccaccaggctacctactaccctaagatacttgctcatctagctgaacaatataacgatgacacacatttatattcatacccaagagattaggtgaggatttaactagtaagacaaagaagggatctgacattctttaaagttaaaatgtaagtccaaaatataagtcatcacaaaaggctgaactcagtaattatcaaaaaattcttccttcctcatgaagtaaaaaggatatttatatattttaagtggcaaaggtgataatcatccaaagtactattaagcaattgattagaaaaagtataaagaaatagatctaaattggtacatcagatgttctctatcacagaagtacagcactttgataggtactatcaaactttttagagtttctctgctgttggaagaatttcattttttgtataaacattctcttccaacaaaatactaccacacaggggaaggaactgttccccacaggtaccctcaggtaatatggaaggtttttaacatgaaccccagttctaatcttgacaacagatttcaggtatgagtacttaataatcacttcacatcctgaaggatatcttactctcaaatgttatgaaaggtataaaatagctacatcctctatctgtgccattagatgtggcttgttgaactgtctagtactcttactctggatttcacctcagaaacccaaccaattctattattttttttatatagcaacaatacaatgtgaaaaattattagtcaagctcatgtgctctaagcaaagagaatgagagccaaatgaaaggggaaaccccttataaaactatcggatcttatgagactttattcactactgtgagaacagtatgggggaaactgcccccatgattcagttatctcccactgggtcctttccacaacatgtgggaattatgggagctacaatttaagatgagatttgggtgaggacacagccaaatcatatcagcatttaatattaaaattgctatttgagtctcttaacttcaacagttttgattattattactagatttcattagggtgacttggcagaattctttagaatactaaaattatttcattcctagctaagtactgttattaaaagtaatggcagaagccacaattacttttccaccaaccttaatattaaggatttgcaaagttcaaaggaacttttcaagtttttcatctactctcttcacctgactgtattgacattccaaagatttgtgcttaaaatctgaaaagaattttagtcatgtatttaagcaatctgtactgtatctacatatttaagcaatctgtactgtatctacatggttcttaagaatttagcacaagaagagcacctgtcacacgctgtgcatgggtttttttctttttggtattcagccccagtccagtgttttcatgatactttgctgtagatctattgtatacatcagtttactggttaccctgaaggtatttctgccttcttgtacagtaatgtgacttttgcatatttattttaatctccactccccaatgttcttcactcccctgaccgccctccctccccaacccagttttcctgggccaagactaccataagcagtaaaccagagaacctgataaatccaggaaaataaaagtgaaaaatttctatttcaatttttatctgcagttttaggctaaagatttcagctcagttcatcccagtaatttccaaccttaaaggataatcactatgtgactgccacattaaattatacatgcatgtattgatcaatatctacaatgccttatctgatattcaaacaacttgaaaataaaaaatttttcgttaaaaaaaaaaacctgggccgggtgaggtggctcacacctgtaatcccagcactttgggaggccaaggcaggtggatcacctgagatcaggagttcgagaccagcctagccaacatggtgaaaccctgtctctactaaaaaatacaaaaattagccgggcatggtggtgggtgcctgtaatcccagctactagggaggctgagacaggagaattgtttgaacctgggaggcggaggttgcagttagccaagattgcgccattgcattccagcctgggcaacaagagagaaactctgtctcacaaaaaaaaaaaaaaaaaaaaaaaaaagaaactctgacatgtgacatgatcttacatgaggctatttatgattttgattttgattttttatatatgattcctttattagtatttaagtgacatctctttacattttttagtggtttctccaggaattaccacgttatctttaacataccccaatctacctagagttaatattgtactatttttagaatgtaaaatatgaaaaccttgctgttgaagagttttaattaccttcttttattctttgtgctattcataaattttacatctgcacattatatcttataatacgagttaaaatttttcctttaaatagtcattaagtcttacaaagaaattaagagaaaatggtatttataaatatttgcagtcagattctttggggctatgtaaatacactgtttctcctttatattttacccacaatttttgcattcttcaatatatcttgtctacagtaattattactgtggtgttctagtggtgattttctattttgcatttatcccattaagggagaatgtatctcagatcagaaatatttgttttaattatgagatactgtactgtgttacctttctaagattaaaaaaaattatgaactataactggctctaagggtttcttttaagggaattatatattattttagaattcatgaatctttaaataatgtagctgttgtcttttaatttcatggtgaatactaagactggttttgtgatagttattctctttatgtaacttctacatatctctactgttaaaagctatctttttcttatggtaaaattggtttagagtggttgacagtttaaagagggatttgtgatgatatctgttcattttcatagggttggggagcagaatatcaccggcaggatgtaaccagcaccccatgttggattgagattatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaa

SEQ ID NO: 9141 - DNA, 4156 bp, Homo sapiens
gaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatggtgagacagatggaacctgggcctctgggaatgccacagtgtttggaaaagcccgttgggggcggggggggacgtgtaggtgaatcttttgtgaccctcagcctcctttcttagtggctctgcggacacttggtccaactcctttcttcaatgagcagatcagggaggaaacgaacgcaggatgtcagagccaggaatgctgggcaggaaggatgtgtgggttccgaggtgagaaatgcagatgagatagggttctctctgaggctttcaggagtggcgaaggtatgtggctttggtctaactttgcttctcttgcagagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtgagggtgccttccggggcagggcgccttccggggcagggcgacagcgttgctgcagccaatggggcctgggtttgagtctcagggtaaagtgagccaatgggaaggtgggcatggcagatccaaggggaggggctaggcatgtgggagaaattggtgcccctgattgggcagaggtggcaaccaccttgaggttgatctctgagaatgggattgggtcagattggcctccgttgtaggccagctggaaagggggcggggtttggagttgggcagttctgagggtcttttgtggagaccaggaggtgtgagtggggcctggtttgtctaggtcatttttttttttctttttctcagcctctacattaatgacatgtttctaggctgggcacaatagctcacgcctataattccagcactttgggaggctgaggcaggaggattgcttgagcccaagagttcaagaccagcctgggcaacacagcaagcctcgtctctataaaaataaaaaaattacccgagcgtggggatgtacacttctagtcccgggtacttgggaggataaggtgggaggatggcctgagcctgggaggtcgaggctgcagtgagctatggtcaggccactgcattccagcctggggaacaggaaaaaaaaggcggaggacacgtatcttggttttctgttttgttttgttttgtttttgtttgtttgttttttgagacggagttttgatcttgttgcccaggctagagtgcaatggcgcgatctcggctcaccgcaacctccgcctcccgggttcaagcgattctcctgcctcagccttccgagtagctgggattacaggcatgcgccaccatgcccggctaattttgtatttttagtagagacggggtttctccgttttggtcacactggtcttgaactcctgacctcaggtgatccgcccgcctcggcctcccaaagtgctgggattacaggcgtgagccaccgcgcctggccatgtcttggtcttttttttttttctttttctttttttttttttttttttgagacggagtctcgctctgccgcccaggctggagtgcagtggcaagatctcggctcactgcaagctccgcctcccgggttcacgccattctcctgcctcagcctcccgagtagctgggactacatgcacccaccaccacgcctggctaattttttatagttttagtagagacggggtttcaccgtgttagccgggatggtctcgatctcctgacctcggcctcccaaagtgctggaattacaggcgtgagccaccgcgcccggcccatatcttggtctttaatgtgcagagacaggtctttggaatagagacacccagccagcctgaaggcttcttcctctggggtgcagccatgtggctcttaggggattaagcctaggcccccacgaacgtttggggagcccctaaagtacagcccagacaggcagtggggtcacgttatgggtctgtcgccttcatgccaagtcctccacacccccgcaggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttccctgcacccagtgcggcaagagcttctctgaccgggctgggctgcgcaaacacagccgcactcacagctcagtgcgcccctacacctgcccccattgtcccaagcccttcttgagtgccagcgacttgcgcaagcatgaacgcacccaccctgtgcccatggggacccccacaccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaccaggtc

SEQ ID NO: 9142 - DNA, 313 bp, Homo sapiens
gaggaaatagtctttttatttttttttttttgagacggagtcttgctctgtcgcccaggctggagtgcggtggcacgatcttggctcactgcaagctccgcctcccaggttcacaccattctcctgcctcagcctcccgagtagctgggactacaggcgcccgccaccacgcccggctaatttttttgtattttcagtagagacggggtttcactgtgttagccaggatggtctcggtctcctgacctcgtgatccgcccccctcggcctcccaaagtgctgggattacaggcgtgagccaccacgcccagcc

SEQ ID NO: 9143 - DNA, 369 bp, Homo sapiens
agcaaaactctgcctcaaaaaaaaaaaaaaaaattatcacaagcattgataagtccagcagtgaacacatctgtttagctttgtttagcccatacttatttgattatggaaaccttttactgagtagttctacttttatcctttcatagataataaactgcagataaaaattagttatctttcctgtatactaaagtaacaaattagaaaatatacttggtggaaaaaggattcccaattcacaacaaaatccatggaccatgaaggaataaacctcacaagaaatgtgcaaaacctgtatgaaaagaaatgatagctccaacctgaaggatatgaaataagacctaagtaaatggagacatataccat

SEQ ID NO: 9144 - DNA, 1264 bp, Homo sapiens
caaaactaactcctccctaaggggtcattcttcataaattacaaaattttttgtgggatcttggatttttgtaaacatgagccacttccatgcttttggccacaccacctttgtggtcatgcataaaattcctctttcagctgacacttatgctctgcttcatgcttgctatatatttaggatttaggaaagtgataatactcatggcacagtatttctgagttcttgttttaacttggcaaatgttttcactaataattttgttggtaaaatatgatattcctaaagaaaatcattttaatttatcatcacttctgacaaaaaatacttggttgaaaaaatattcattgcatctttatgaacatctcccatataatataccagctataatttaaatgttttccctatgtccagtacttctaaatggtcaatagactatggttggccatttggcaaaactgacttctcaagaggaaacaagcatattttgataaaaataatcttgttactcaaggtcattaagtaattgatgaactatgtacaagtttattatatctctttttatcttgtagctacctgtcagtatcacgttttttttcctaaattgtaatccttcatgcacagaaatgttccatgtggcaacttcaaagacaacctgctgagaaaccaagagaatatttaataatgctcaagagcaatgaggcatgaatgatcaaatgaaggtctttccagttagttattgattattctatcatggcaggtaacttcaaacaccacacacaatcttttgaacattaccttcatctcctaatatttctatcactagaagaaattactttccttgaccttccatagcaggcaaatctgttttgcattatttattgatcttataatataatattcttggagggataaatgagactcatcaagttcaaataaattataattgtagaagtcttaaaggtaacccttatattctcatatacttaatgcagaagaaaactgttagttctcatagatggacttctagaacaccatccaggacttaaaagtttaaattgaaagtgaacttttattttagactttttaacaatatatgtcaaagtgccatttggcaactatcccttaacatccagaaaactaatgaagtgcaggtaggttacaccttagcttactagtccttatggttatctccttttctaaaatgacaaaagaacttgaagaattagctgtggaacaaaaaaaagaaaatatactctgctca

SEQ ID NO: 9145 - DNA, 1717 bp, Homo sapiens
gtagcgtgacagcaaatacgcacaggaaatgccgtggaccctggcaaatgtagtgggtaatttcatgcaagcctggagacacgtcgctctgctggcatgaacctctccatgtgtgttttcacgtcctgcctcaccacctggagcttcccatggaggcacaatcttgaattggggctgaatgaggaggccatgtccccagggatcccctcaatcaatgaaagatggaagcaggtcattgccccagctttccatctgttagaggcaacagtgcttgtggctgtcttgtgcgcttcttggagatcctggtgggatcaagtccccattgctcataccatgaatcaggaaatgtgcccttataatattcctccttctcctcctcctttctctcatcctcgttgccccttcaatcttgtacctaaaatcatctcccaaacaaaccacccaccctcatgttcttcaattagtttcccccacacaaaagaaccccaaaataaccccaaattagacacacttaatgttgctagcttctctctttgctcctgacagtgtaataataaccttttaatttatatagtattggtgcttaaaatgtatccttttccttaaattgttagagcttctatatacctcatccatgtgatagttagaatagtctgagaagtaaagtggttgtttccagggactgtgagattgaggtgttggggagatcttggtcagaggctacaacatttcagtgagacaggaggagaaagtttaagagctccattgtacaacatggtagctgtagttgataacattatattgtattttttcaaaattgctaacagaagattttaagggttgtcactataaagaaatgataaggatgtaaagcaatgcatatgttaattagctcaatttagccattccacaatgcatccatattttaaaatattatatcgcacatcataaataggtataatttgtatttattaattaaaaatagcttttaaaaacagtaatatcacactcatgaattagaaaattctagttcagatttaatacattttaattgttatatacacaacttcttaccctggtgataaatattttccagtagcccatcctcagttattctactaatgctttttgtaccagtcagtgttctgaaaaaaaaaatctccttttttgttagtttctgaataatgagaacattgaaaattggataccccttgcaaataaaaatgtctcttcaaaatgataactgggtagtaaaactgcttttgattgtaatagtcatattgaagaaatgctcatcttttctagctgattaagtcactgtattattgattgttggttttattcattattaagttggtggaatagaactcattggtccttccattatttctttaggaaagttgtacttttagataatggaaagcagtaagtatgtggaattgatgttaaaacacgttcatcgtttatcatgagcaagttcacagtcaagatctttgtccagcaaccaaatataatatatataaaataaagaaaatataagaagacaaactattcaaaacaacttctggagaaaatttccctgccaaagaagggtcacattcaaagtgtgtcacaaaacctaacgtctttcccctatttttcttgttctccctccctctcctgtatgcatcagtgcttccaaagtgctcttcagtcatttattaaagcctctgtccca

SEQ ID NO: 9146 - DNA, 1718 bp, Homo sapiens
gtagcgtgacagcaaatacgcacaggaaatgccgtggaccctggcaaatgtagtgggtaatttcatgcaagcctggagacacgtcgctctgctggcatgaacctctccatgtgtgttttcacgtcctgcctcaacacctggagcttcccatggaggcacaatcttgaattggggctgaatgaggaggccatgtccccagggatcccctcaatcaatgaaagatggaagcaggtcattgccccagctttccatctgttagaggcaacagtgcttgtggctgtcttgtgcgcttcttggagatcctggtgggatcaagtccccattgctcataccatgaatcaggaaatgtgcccttataatattcctccttctcctcctcctttctctcatcctcattgccccttcaatcttgtacctaaaatcatctcccaaacaaaccacccaccctcatgttcttcaattagtttcccccacacaaaagaaccccaaaataaccccaaattagacacacttaatgttgctagcttctctctttgctcctgacagtgtaataataaccttttaatttatatagtattggtgcttaaaatgtatccttttccttaaattgttagagcttctatatacctcatccatgtgatagttagaatagtctgagaagtaaagtggttgtttccagggactgtgagattgaggtgttggggagatcttggtcagaggctacaacatttcagtgagacaggaggagaaagtttaagagctccattgtacaacatggtagctgtagttgataacattatattgtattttttcaaaattgctaacagaagattttaagggttgtcactataaagaaatgataaggatgtaaagcaatgcatatgttaattagctcaatttagccattccacaatgcatccatattttaaaatattatatcgcacatcataaataggtataatttgtatttattaattaaaaatagcttttaaaaacagtaatatcacactcatgaattagaaaattctagttcagatttaatacattttaattgttatatacagaacttcttaccctggtgataaatattttccagtagcccatcctcagttattctactaatgctttttgtaccagtcagtgttctgaaaaaaaaaatctccttttttgttagtttctgaataatgagaacattgaaaattggataccccttgcaaaataaaaatgtctcttcaaaatgataactgggtagtaaaactgcttttgattgtaatagtcatattgaagaaatgctcatcttttctagctgattaagtcactgtattattgattgttggttttattcattattaagttggtggaatagaactcattggtccttccattatttctttaggaaagttgtacttttagataatggaaagcagtaagtatgtggaattgatgttaaaacacgttcatcgtttatcatgagcaagttcacagtcaagatctttgtccagcaaccaaatataatatatataaaataaagaaaatataagaagacaaactattcaaaacaacttctggagaaaatttccctgccaaagaagggtcacattcaaagtgtgtcacaaaacctaacgtctttcccctatttttcttgttctccctccctctcctgtatgcatcagtgcttccaaagtgctcttcagtcatttattaaagcctctgtccca

SEQ ID NO: 9147 - DNA, 1717 bp, Homo sapiens
gtagcgtgacagcaaatacgcacaggaaatgccgtggaccctggcaaatgtagtgggtaatttcatgcaagcctggagacacgtcgctctgctggcatgaacctctccatgtgtgttttcacgtcctgcctcaacacctggagcttcccatggaggcacaatcttgaattggggctgaatgaagaggccatgtccccagggatcccctcaatcaatgaaagatggaagcaggtcattgccccagctttccatgtgttagaggcaacagtgcttgtggctgtcttgtgcgcttcttggagatcctggtgggatcaagtccccattgctcataccatgaatcaggaaatgtgcccttataatattcctccttctcctcctcctttctctcatcctcgttgccccttcaatcttgtacctaaaatcatctcccaaacaaaccacccaccctcatgttcttcaattagtttcccccacacaaaagaaccccaaaataaccccaaattagacacacttaatgttgctagcttctctctttgctcctgacagtgtaataataaccttttaatttatatagtattggtgcttaaaatgtatccttttccttaaattgttagagcttctatatacctcatccatgtgatagttagaatagtctgagaagtaaagtggttgtttccagggactgtgagattgaggtgttggggagatcttggtcagaggctacaacatttcagtgagacaggatgagaaagtttaagagctccattgtacaacatgatagctgtagttgataacattatattgtattttttcaaaattgctaacagaagattttaagggttgtcactataaagaaatgataaggatgtaaagcaatgcatatgttaattagctcaatttagccattccacaatgcatccatattttaaaatattatatcgcacatcataaataggtataatttgtatttattaattaaaaatagcttttaaaaacagtaatatcacactcatgaattagaaaattctagttcagatttaatacattttaattgttatatacacaacttcttaccctggtgataaatattttccagtagcccatcctcagttattctactaatgctttttgtaccagtcagtgttctgaaaaaaaaaatctccttttttgttagtttctgaataatgagaacattgaaaattggataccccttgcaaataaaaatgtctcttcaaaatgataactgggtagtaaaactgcttttgattgtaatagtcatattgaagaaatgctcatcttttctagctgattaagtcactgtattattgattgttggttttattcattattaagttggtggaatagaactcattggtccttccattatttctttaggaaagttgtacttttagataatggaaagcagtaagtatgtggaattgatgttaaaacacgttcatcgtttatcatgagcaagttcacagtcaagatctttgtccagcaaccaaatataatatatataaaataaagaaaatataagaagacaaactattcaaaacaacttctggagaaaatttccctgccaaagaagggtcacattcaaagtgtgtcacaaaacctaacgtctttcccctatttttcttgttctccctccctctcctgtatgcatcagtgcttccaaagtgctcttcagtcatttattaaagcctctgtccca

SEQ ID NO: 9148 - DNA, 98 bp, Homo sapiens
gtagagacggggttttaccatgttggccaggctggtctcgaacacctgacttcaggtgatccacctgccttggcctcccaaagtgctgggattacagg

SEQ ID NO: 9149 - DNA, 98 bp, Homo sapiens; identical to SEQ ID NO: 9148

SEQ ID NO: 9150 - DNA, 98 bp, Homo sapiens; identical to SEQ ID NO: 9148

SEQ ID NO: 9151 - DNA, 57649 bp, Homo sapiens
agtgttatgtgccaagaaccttgcaaagaaagacttcttcagtaagtaaacacttatttttttccctcttataatgttatgcatgtatttctgaaattttaaactttaaaaaaagattgggtatattctcttcaaagttttgccctttacttaatagaaatccatggttctccaagctttatttcccggttgactacaacatgggtagttccttagctgaaatatacagaacttataaatcataccgcaaaacctgtctttcgtttcctattctggtcacacccaattttttctgcctctctacctattagaatattgctttctgctggatgatgtattctcagctctaatacaaatgaaatacttttgtataaaacagctggatttgcatacaattgttaatcagattttataaattaaatcacatttacaacaccctataattaaaggaattgcaaaaataagagactccttttctaaaggaaggaatcactccttaagaaagtcatgcagtatctggtcagtgcctgcagcattaaattcttcacacactttctgatcctcacaagacatctttcagttcttaagtggtattattcatgctttcaagatgaagaaacttaggctcaaaggctttctccaggtagccaggaagctccagcatggtggctcgtgtccatctctatctctgacaactgtccactttgccacctgtctgatctaataaacctctctgattcattctctagcatttagggacttaccgaattaaggcctggtgaatacttgcttccatagataagataggcaaagatcagtaaacaaatttcggggcattattaatttttagaaagtctaaatacaattactttcagacacttttccctccacttaattagccccactttaatagaaatttgaatgtaagcctttttttttttcagtcactttcttttctaccctctaaaaatctgagtatggaggcatactaggctctcttagaaagctcaatagacataacttattttgctgattgaaattatcctgaaattagagaacacgaattgtgtgttctgtgtcacatggatggatgtgaggtctcatctaggtgtgggtctcctctctcctctagggctccctgacccttttgcaaagattgtcgtggatgggtctgggcagtgccactcaaccgacactgtgaaaaacacattggacccaaagtggaaccagcactatgatctgtgagttgaatgttctgtaagccccatgcggagcggcaggaaagcaggtgtctaccttttacgagaaacatccaagagaaaaaaaaaaaaggatgactttttattgataacaaaagcggatggccaaatgaatgtctacattgcctaattttagaattcatgtacttggaagttcttgcattttgttactttcttttttcttttttttttttttttttgagacggagtctcactctgtcacccaggctggagtgcggtggcgtgatctcagctcactgcaacctccgcctcccgggtacaagtgattctcctacctcagcctcccaagtagctgggattatggacatatgccaccatgcccagctaatttttgtattttttagtagagatggggtttcaccatgttggccaggctggtcttgaactcctgacctcaagtgatctgcccaccttagcctcccaaagtgttgggattacaggcgtgagccactgcgcccgactgcatttggcatgttcatagatttttatggtttggttttgtacatgtgatcctcaaacttttcaatctcctggccattttagcagaaaaaaaggccatagtttgtgaactccacatgctactgtttttcagcaaaaccctaaacctagttgtagtttctacctaaaaaatgcattttttttttttttgagatggagtcttgctttgtcgcccaggctagagtgtgcagtggcgcgatctcggctcactgtgacctccacctcctggattcaagtgattctcctgcctcagcctcccaagtagctggaattacaggcatccgccagcatgcccaactaatttttgtatttttagttgagacggggtttcaccatcttggccaggctggtctcgaactcctgacctcatgatccacccgcctcagcctcccaaagttctgggattacaggcgtgagccactgtaccaggcctaaaaaattcattattatgactgtatgtttctgttgactttgaaaatttttgctttttagtacatatatattttctgcaagagaaaatatagttttatatgatcaaagccatcaatttcttatagtcattcaaaaactggattgtactttgaagaccactattttattttattttattttattttattttattttattttattttattttattttattttatttttttttgagatggagtcttgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctattttatttttaaattaaattaaatttttttttcaaacagagtctcgctctgttgcccaggctggagcgcagtggcgcaatcttggctcaccgcaacctcctcctgctgggttcaagcgattctcgatcttcagcctcccgagtagctgggattacaggtacccgccaccatgcctggctaatttttatatttttagtagagatgggtttcaccatgttggccaggctggtcttgaccttctgacctcaggtgatccaccttggcctcctgaagtgctgggattataggcgtgagccactgcacctggctgtgaagaccactattttatatgcacccatgttttcatgttcctactaagatattttcatcaaagtaatcctgaaagattattgtcttttagttaatacaaattatactgtatttgggtgggatttttaagaattatattctaagattcagtttcagtgacactgaggctgtgtaagtgggttgagttcctctctccgttgacttgcagtgacagtaaatggaggtttaatgtcttagtgtcctcttgtgtactttgaatagatccgtaggtttgtaagtagtcccttgtcgcaaaccagtattctgtatcaaacctaattggtgagaatttatgaatcatgttactgtcctatgcgactattaaaatatagtaaatttgctgggtgcagtggctcacacctgtaatctaagcactttgggaggccgaggcaggaagatcacctgaggtcaggaggttgagaccagcctggccaacatggtgaaaccccgtctctactaaaaatacaaaaattagccaggtgtggtggcaggtgcctgtaatctcagctgctggggaggctgaggcaggagaattccttgaacccaggagacaggttgcagtgagctaacactgcgccattgcactccggcctgggcgacaagagcaaaattccgtctcaaaaaaataaaaaaataaataaaaataaataaaatatagtaagtctgttataagattattatcatcgtgtggttatctacatttgccccttccataaggagcaaggtagttcttcttcccagcttgttgaaattaatggatacgtatttattaaatgcctgttacatgtgtaatacagaggcaacattattttataaggtttcttaaagagaaaatctcaatgagatatcataattcagaaatacaattaaaagctgggcatagtagctcatgcctgtaatcccagcactttgggaggccaaggcaggtggatcacctgaggttaggagttcaagaccaacctggccacatggcgaaaccccatctctactaaaaatacaaaaattagccaggcatggtgatgcacgcctgtagtcccagctactcgggaggctgaggcaggagaatcacttgaacttgggagttgcagtgagctgagatcacacaactgcactccagcctgggggcaacagagcaggattctatctcaaaaaaaaaaaaaaacaaaacaaaaaaaaccaaacacaattaaaaatgagttttgcactttctttccagatatgttgggaaaacggattcgataaccattagcgtgtggaaccataagaaaattcacaagaaacagggagctggcttcctgggctgtgtgcggctgctctccaatgccatcagcagattaaaagataccggatgtaagaaccaaacactttcctgcctcttaatgcaaccaaagaaagcttaggaggcatcgttttttgttttgatcgctgaatactgaattcctgccttcctccctagttcacgttccttgggttaagttttgaattgtttgtttacagaccagcgtttggatctatgcaaactaaacccctcagatactgatgcagttcgtggccagatagtgggtaagaactttcttgtctgtgtaaagagatgcttttccagaacttacattcaacccttcatcgccgagaactcacatacaggcactgacgatgctgacgggcctcagaggacagaccacgtacggggccttctcttcagtactaggaagttttgtcttgtgtagtttttattattttatctaattcccttctcctggcttttttttttttttggtttttttttttttgagatggagtgcagtggtgagatctcagctcacctcaacctccgcctcccaggttccagcgattctcctgcctcagcctcccgagtacttgggaccacaggtgtgtgccaccacgcctggctaatttttgtatttttagtagaggcggagtttcaccatgttggccaggctggtctcgatttcctgacctcgagtgatctgcccgccttggcctcccaaagtgctgggcttacaggcgtgagccaccatgcccggcccccttctcttggcttttaaagttgagtaaaaatgactcgggtacagaaagatttagggttagaattttaaatgtaattttaatcatcacatttatggacaatacatttttgaccgtattatccaagggtagataataagaatggtggccacacatacaggagttgggaaatagtttcttctggaagccccatcatatatgtaaaaagcatagagttgtgaagaattccatgtaatatgatttgtacagtcaggggactgcattatttagaatgaaaaattaaagtgtgctaatgttacaaagtgttggctagaggcagtctgttggaagtgatttagctgttaaataactcatcctattatccacccacttgtattagtgttttagggtaactcagatattgacttggaagcactgctgcatggaataaaaaaaaaaaggtctctctgcagcacactggagtgattctcactccaaatcttttaggtattgtcctgtgtagacctgacccaagataaatgaatagtgcagacatacaccctgaaatctaccatcatgaaaaagttctcaccgaatgctttcctgcgtgtaatttcttttttctttgtggcgggatgtgccagggagaaaaatgagtaactgaaaacaactttataaaagtcttgttcatagtaaagatagagaataaatatttagattcacttagactttgcagatactgaaagtactctctgtgtctttattcattttttttttgacacggagtcttgctctgtcgcccaggctggagtgcagtggcatgatcttagctcactgcaacctccgcctcccgcgtttaagcgattctcctgcctcagcctcctgagtagctggagttacagctgcttgccaccacgcctgggtaattttttgtatttgtagtggagacggggttttgccatgttggccagactggtctggaactcccagcctcaggtgatccgcccgccttagcctcccagagtgctggtattacaggtgtgagccactgtgcccggcctctctgtgtctttattaaacttaagtcagaatgttcttaagaaataaaaactgggctcagtggcacatgcctgtagtctagctactctgaggctgaggtgggaggattgctcaagcccaggagtttgaggccagcctgggcaacacagtgagacttaatcccccccaaaaaaacttcttatttttattattttttttaatttttaattttttttggagacagagtctcactctgtcacccctgctgcagttcagtggcgcgatcttagctcactgtaacctccgcctcctgggttcaagcaattctcctgcctcagcctcccaagtagctgggactacaagtgtgtgccaccatgcctggctcatttttgtatttttagtagagatggggttttgccatgttgcccaggctggtctcaaactcctgagctcaggcgatcctcccttcttggcctcccaaagtgctgggattacaggcatgagccaccgtgcctggcccaaaaaaagtcttcttaaaaaataaatcttcttgaaaataacttagagggactgaatattacattgttatttttatggagaccaggagaaacatagcacccttttcttcaccacatttacaaggaatattccaagtagcatgcagctactggagtaaaatgcttcgtattggaaagcataggaatatatgtgtgtatgcatacacatatgcctcgttttttatgatattgtacataaattctaaattagcaatgactcactgtattataattatgtaaaccccgctgggttttaacacaagtcgttcttttctcttttagtcagtttacagacacgagacagaataggaaccggcggctcggtggtggactgcagaggactgttagaaaatgaagggtacgtataaccacagcaagaggcgggctgagttctctgctgccttaacctctcggcctataggaaagcgcccttccctccttaagtcactctgcagaatgcttgagatgcataaaggatgttgggataaaactgtgaaccagtttacttggctataaaggaagctgtaaatacaactggagttggctgggcgtggtggctcacgcttataatcccagcagtttgggaggccgaggcaggtggatcacgaggtcaggagattgagaccatcctggctaatacggtgaaaccccatctctactaaatatgcaaaaaattagccaggcgtggtggtgggcgcctgtagtcccagctactggggagactgaggcaggagaattgcttgaacccgggaggagggggttgcagtgagccaagatcatgccactgcactccagcctgggtgacagagcaagactctgtctcaaaaacaaacaaacaaacaactggggttgtgcctgactcaaaatccagtgaaagaggctcccacgggccaaagatgggtgagtttgagcatcaataagaattataactgcctgtaatcccagcactttgggaggccaaggtggccagagactttggtctcgagtttgagaccagccagggcaacatagcgagactttgtctctaccaaaaaataaaaaataacaaattagctgggcatggtggcacgcacctataatcccagctgctagggaagctgaggtgggaggattgctttgagtccaggagtttgaagttgcagtgaaccctgatcacaccactgcgctccaccttgggcgacacagcaagaccctggctcaaagaaaagaaaagaattataactgccatgaatttggaacatatcagatatattaaaaatctttgggttcataatgacggggggaggaactcaacacactaaaaaaatacaacaaactgccgaaccgtcattggtcactgtcacaattttgcagtcccccatgaattaatggacctggccaacaagcagtaattgctaacaacatcacaaaagagagatgatccaacattaacacacctcttggaaatacagggaaccaggaatgtgtctcacggccccaagggaatataatcaacaaacatccagaatggggccttctgtaggacagacaacccagggtcttcaacaaatagactgcaagaaaagcaaagacaggagggaaggagaacctgtcaacaattcatattcaaacaaacttgagacatagctacacatgcaaggtgtggactttggatcctgatttatgagacaattggagaaatctgaacaccggtatttgatttttttaaaaaattaatgaacattttttagtcatgataatggaaatatttaaggatgaagtcataaaatgttggggttggtggggagggattggaagagtggacattggatgatggttagctgggaggggtggacacagggggttcattgtactggtctctcattttttatacatatttgaaatttttcaatctaagattttaaaagagtatttgcttctaagggacagtagcctattaaggtgaattgtcttcaaaattgctcagggggtgaagattgatgtttaaaaagtatctaaaggcattttggcattttatgtaaccaggagtttcattatagagtaaaataacaaggaaaatggagtatttggatatgattttattttattttaaagatggagtctcgctctgtcacccaggctggagtacaatggcacaatcttggctcactgcaacctctgcctcctgggttcaagcaattctcagcctcccgagtagctgggaccacaggcgtgtgccaccacacccagctaatttttgtatttttagtagagatgcggtttcatcatgttggccaggctggtcttgaactcctgacctcaagtgatctgcccacttcggcgtcccaaagttgggattacaggcgtgagccaccgcatctggcctggatttgattttaaatcaagaaaaatgagatctcatttcacaaactcctcatagtctaaggctggtttcttctaatcatttcagtctaccctatggtgaaattgtacagttggccttggggacactccggccacctgttcctcttagaagagtctgtctttctgtttgagtggcacatggtgaattttacaaaactaggcccttggaacactggacgttgttaaaggaaagcaaatcaatttatgtgacggtgtcccctaggacactagccctaaggcgctggtcttgtgactcctccatggtgacaccatgcctgcctgctctcgtccctttcagaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacggtgagagaatgtatcctgctgtggccaatgccatctgccctgtttccatgagttgactttttttttttttttgagacaaggtcttgctgtcacccatgctggagtgcagtggcatgatcatggctcacggcagccttgacctccctagctcaagcgatcctcgcgagtagctgggcttataggcatacaccatcatgcctggctaatttttgtattttttgtagagaatgggtctcgccatgttgcccaggctggtctcaaactcctgggctcaagtgatccacctgcctcagccgcccaagtgctgggattacaggtgtgagccactgcatctggcctttaaccctttttgagtagcctgtgccataagtgcggatgtttgcgtggctatgccatttgataattgtggcagtgtaaagacaactggaagacaatggtcctaaatctagctaatcatgaattttcagcaattgctccaaatctcccagtttagaaatcaagtgaaaatcttaggcaaacgaacaccaaagcaaaccaaggtaacatgtaggctagatgagggtgtctgtagtgctctggaaaggagagcatggggcgagatggagaagaggggattattcggccacctcagagagaagaactgggataagaggggagtgttatctagatttagataataccagacgtgagggcatcgagggttggttacaaactctccctggaattgaacttgtctcatttggatctctaatttcttgtgtagaacaaagaacaacagtccagggccaagtttactttttgcatacacagactggagttagcacgtggcacgaccccaggataccaaggtaagcctcctgaaatggacaccccccagctgtctttccagcagttgacttgaaaagccaataccttccagatgtgttgctcttgttttaaactaaaaatagtgatgaatgagatgatattgatgtctgggatttccttcagataagctggggtggggggagtagacaggggtacatttgaaacgtgagtcattgttgacctttgaaacaaggttgaccatgatcattgttgaagttggttacacagcaattccttatgatcactaacttttttatatgcttaaaattttccatcataagtcaaggaaatataaagactctgttaccctttctctcttctactttactgtccccattgcctcagtccctcggggaccattcctgggggagatgcagcttttctatacgaattccttctacaaggccatacatctgagcccaggttagagagaccccccccccaccccataacagagttaagtttctttttttcttttgctttttatttccttttagaatagcattactacctaatatgatttttggtaatatttagttcctttttattcatgatttgtttcatctgagaataaacttcctgtctgattttccaagactatgtttaatgtatgactcagtacctataatgagactggaaatatattacctgcaaatgaatgaggtgtctcttttgtaccccctgttagaaatgacaggcttttgtgttaattagaaacacatcttggtcagtaaagctgtgctcccttctgactgtagattgtgttgaaattattaatcaggagaataattaatcattcttagagtggaaaatacttgttgagcaaaaagcccatttgaaaatgagaatgcctcgtcctgctgcaactgtttagaattgcgagtttctgaacgcatgttcctgtacctcccttagccctgaaaagcttggtgctgtctgggaactttccaatgaagaaacccttctggccgggaacatttaatgacacttgtgaattcagatagttttctgacagcactaagatacttcctactattagggccttctttcatataagaaatgatatgccgtggggagcccctgttccttatcatggttataagctctgaaactgcctatttttttttttggagatggaatttcactcttgttgcccaggctggagtgcaatggcgtgatctcggctcactgcaacctccgcctcccaggttcaagcaattctcctgtctcagcctcccaagtagctgagattacaggcacccaccaccacacccaactaatttttgtattattagtagagacagggtttcatcatgttggccaggctggtctcgaattcctgacctcaggtgattcacttgcctcccagagtgctgggattacaggcgtgagctaccgcgcccagcctgaaagtttggttttaaatctctcggatgttgctgctgtttgcagcagagaggcctggactgagtagaggtttggcgtaagtagcaccacgaaggtccatcttagcagagctgggacacagacaccttgataaggaacctctgtggcttctgttgctgacttttggtctcattcctccatactcagttggacaaacctctctgtatcttccattttggtagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaagtaagactttaaaaatattttttgctgacctctttcattggtaatcgaatgctttcttggactggtatttttgtgaatttattgactgtcttgctggttggataataagcatggtcaaaatgatgttaaatatctggcggataattgcatattttaaactcttaaattagctgtgaagagcactgaagccctatgttgttgctacccttttcttacttgcagcctacataaaatttaccgagatggcagtattaggcggctgcacgaaggaagtttccgcacgcagcgctctcatgagacacgtggcccttaggttgagaagtagagatacgtgctatccccctagtgcctgcacggtggggaactggataccttggaactgggaattatcttggatcccatatttagtgttccaggcctgtcgtgttctcagagccaaacattccacatagctctttttttttttttttttgagacagagtccagctctgtcacccaggctggagtgcagtggcacaatctctgctcactgcaccctccacctcctgggttcaagtgattctcctgcctcagcctcctgagtagctgggattacaggcgcccgccaccatgcccagctaattattgtatttttagtagagatgggattttgccatgttggccaggctggtcccaaattcctgactgcgggtgatccgcctgccttggcctcccgaagtgctgggattataggcatgagccactgcgcctgcccccgacatagctcttttaaccgacagctctgtgtctcagtggcaaaacttgaacaggacaaatgccactttgtcaccgtactaatcctactccttttactgaaattttgctctcaatgagcaggtgtagaaatctcttggcggtaaaaatgagggatggttttcattagatttcactcgagcggtctgctgttgtgcctatcatgagatttcatttgagttctccactgttacctcctttaaaattttttcccatcatctccatttcattctaactgccaaggtgcatctgatgatgctttggttcatctcatgggtgcgtaatagatgcataataaatgacagccatttccatttttatttgtggtggtaatgtgtgagataagtgtttgcttggaattgtggtacctccttttttttgagagagagagtctggctctgtcacccaggctggagggcagtggcgcaatctcagctcactgcaacctctgcctcccgggttcaagcgatttccctgtctcagcctcctgagtagctgggattataagtgcccaccaccacacctggctaattttttgtatttttagtagagaccgggtttcaccatgttgtccaggctggtctcgaactcctgacctcaggtgatccacccacctcagcctcccaaagtgctgggattacaggcttgagccaccacgcccggcctggggtacctcctttatggtactgtagacatacatttaggctaatgtggccatcagcaagtttgacacagctagctaggtacctggttacgtcatcagggaaacaaattctccctgaagttgtgtgcagctagctctctcctctgaccctgtcgcgtacgtgggtgcttgcagctcccctggccggggcttcggagtgactttctgcatctcttcttctcaagtcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggtagagagttcagggccactgcccagaccctgttcagaaacaaataaggcaattcagacaaaggaatctcaaatgcgattgttttcaagggctgctttaaatgaactgctttgtgggtgatgtctgcgtttcagggaacccttctttctgtttggtatttgaggtattgattttattactaagggaagtgcagagtttgtcaggaccacagcctgtctagagggagggaatggtattcatttcctcttatggtaaaaatggaaaaactaaatagtttcacctctaggtgaaaacctagaggtgtatacagaaactagcactaaaaaatagtgggaaccgccttgtctacatgatgtgggttaaatattcctgcaatctgcaatctgcgctttccccagagccaggtagtctccctcctctcttcttgtatgagatgtcatctgagggctctccttctcagggcagctcaggggctgggggccatcctgcttctcctgtggaaattggcgaggagcaggtggctcttgggacaggctctgtcccttacacagcttcctgcaggagcaggtccctaaacagaccaggcccttttcccaagaaagctgaccatacaggaaaatctccatggcatttgggccatttcctgccctcctttgtggagacactgtcagaaatgatcaaaggagactgagcacagattctccctgggtgacagcactaagggagcactggggggccgagggagctgagcgccttccccaccgcgagggctgggcctgagtgttggatgggcagcttggccacagcgcccagccctgcctgctgcatgtatgcccttgttgcagggctagaaaagcgctgaagtactgacttcactaccagctcgtttcctctttccctcttgggttgccagagtttatttgtttgggtttttttttttttttttttttttgagacggagtcttgcactgttgcccaggctggagtgcagcggcatgatctcggctcactgcaacctctgactcccaggttcaagcgattctcctgtctcagcctcccgtgtagctgggattacaggcgcccgccaccaggcccagctaattttttgtatttttagtagagatgggggggtttcaccatgttggccaggctggtcttgaacttctgacctcaagtgatccgctcactttggcctcccaaagtactgggattacaggcggagccaccgcgcccggctgggttgctggagtttgaattgcgttaaatttaaagcacgaaaaatttcttaagtgcctcgttactgaatctacatctataaacacgtagcggcttctgcttcaagtgctgagtgtgagggaatagcaggctgatcacatgtgttctgtgctgtgcttaagccaccttatgtcttacttaaaatctttttgccttttgactcagtgggaaatcaaatgtgatttttcactttagatataaagagaggctcagaactctcttagcattcagactttctaatgtcttgattttggttgcgatgcacaagttgtttatagtgtgcattgaaattaatttatacagagaagaatcaaccctagtgagttttgtccttaagtccttggtgattcactgaaaacagacacgtgtttccctgaaggttagtgtttcctggcatcgtgtttgttttgttgttgtctcagagggagaaactgagaaaaaagatgatggaatatactagatgccgaagaaacattctgatgaggagccagataaaacttgaattggaatggatgcgtgttcttaaccgggctccattatcaatgacctttcataactttaagaataagaatgttcttctctctgaaactgtgatgttgctcttcaggagtcttaccgccagataatgaagatgcgaccgaaagacttgaaaaaacggctgatggtgaaattccgtggggaagaaggtttggattacggtggtgtggccaggtgagctgcttgttcattcaccttctctgctgtgtggatctcagtcttttcaagagaagtcatttgcccttctccagtgctcatcaccaagcactcctgggcagggctgatgtctccttggagcagtcgggccatcatgcactggcttcagccaccctgcggagaataggaattcctccgagcatgctcgtgccagcctcttgccataacctaccagaatatccgtgattgtcaccactaattgacttcttgtaaagctagaattaaacttttaaattcactcccttcttttgaaacatgaggagcatgctcctgaaatttaacacaggaggcagccttgctctcctctgtagaggatttgctgcagggagcagggcagggattgcatttgtgcatgtaaattgcatttgtgtcaaaggaattttgtaaaatgttaaaattttggtcaaaataattcaagaaaatgatattaaaaaacagaatagaatgatgaaaaactgctatttcatgtcctgcttcttttcagcttcaagacaattttttttttttggtcttttttgagacggggtcttgctctgttgcccaggctggagtgcagtggcacaatcatagctcactgcagcctcaacctcctgggctcaagcgatcctcctacctcagcctcccaagtagctggaactacaggtgtgtgccaccaggcctggctaatttttaaaaagttttttgtagagatgaggtcttactatgttgcccaggctggtctcaaactcctgggctcaagccactctcccatcttggcctcccaaagtgctgagattgcaggtgtgaaccgctgtgcttggctaagacaactgcttcttaactcttttagctcttttctttgaataggtatcttgttatttccggatttaatgatttatgggcatatacataagatagactgactctagttactctcatgttcaatttagtaatatggatctttttagttcttccatcatttgtaactttatgtcctgtgctttcacctttatttttttgatgtatcaactagagacatgatctctggacctctcatttgcataagaacaggatattcatacttacaactttctcttcagcattccttctgcctcttaaattctgtcatctgtaatattacttttatgttgtcaaggttaagatttacattctcttctgtaaccaaaatttggtcagtctcctatgcttgtctaccaattatttgtaaagggatgaaagtttatacggtttacattattatgaatgaaaatattgtccattaagggtttaaatagtattctagaatttaactttttggaacaaattctaatttttccaagaatttcttcttcccttttttttctggagacagcatctcactctatggcccaggctggagtccactggctggatctcggctcactgctacctccacctcccaggttcaagtgattctcatgcctcagccccctgagtagctgggattacaggtgcgagtcaccatgtccagctaatttttatatttttagtagagatggggtttcaccatggtggccaggtgggtgttgaactactgacctcaggtgatcctcccgccttggcttccctccccagtagctttcactgtctctactgccccttgaacttcaagtcctccaggatggttacacatcataccttctgacagcccccgtgtctcctgcaaggcctctgtgcagcctgatggcgattctcttgctcctctgtgccgtggttgtcctgagacttcactgcttccctgggtgaggtccattgtcctgggcgtcccatagcttcccctttcttggcgtcctcccttgtcatgctgtgaccaccgcatggttgtgtggtgtgatgtttctctttctcatctgcatcttccaagagagtcaaactacatgcagtcaggaacttgtcttgttcacagctgatccccggttcctagaacagcacctaacacacagcggaacacttgtctctgtaaatatgtgccaaatgaatgaattttactttttgttaatttcttcgcacattttctttctttggtcattctgaaatgcctgttactcagctgtcggactccctggtttggtctggtaggagttacattccttctgcgttttccgtagtcatccagtcttctgcgtggagatgggtcgttgtgaatttcccttgactgacatgatgctgtagtggaaagagttgggaatctctgctctgccacctccagtttggtcttgtagtgttatttcaccactggagtcttcctcctaatgggatgatacttagagaacggtggagagatttcagttgcatgtgtattacacatgtgcaggtgtgtgttcattatccgatctgtgggagttaggctacacttatctccccagtatttagtcctgaagtcctttctgtagcctctctttttggcctgtttagttattgcttcccttaccacttccagaacagaactgattgtatctttacgctgtccatggctcggtcggaatgtttgcttgtattttaatcacttcctgtctagacaactggaggtctttgtctttttcaaaaaaggttcttcctaaattgaaactccaaaacttgggatgaattcaaattcagcaatgttgcctttgtagtaaaaagagactttataggattcggagtctcatctcttctggcagttcctttctgttcttttgagtacaatgaagaactgtttttgtttgatattttttgtgtattctcacgattttcttggacagattatctgcatttgtgtctgtccttccctattcgctctcatttctgtttgaaaaagtaagaaattccagaataaaatttggagctgctatcttaatgcgatccgttgaaaaggagttttgagcagaatgaatagaagactcttcgtagatctgccacaggtgtttgtctaagggctgggcttaatgcaacctgagtgtagccactgaaccatacaatttctatttaaagtgccttttttttggcttgactgtttttaactttggggtttttaaaataataaaatgatgcaaacattaaagaaattcagaaaataacaacttaggctgagcgtggtggctcacgcctgtaatcctggcactttgggaggccgagatgggtggatcatttgaggtcaggagttcgaggccaccctggccaacatggtgaaaccctgtctctactaaaaaatccagaaaatagccgggcctggtggcgcatgcctgtagtgccagctactcgggaggcaggaaaatcacttggaccaggaaggcagaggttgcagtgagccaagatcatgccactgcactccagcctgggcgacagagtgagactccatctcagggaaaaaaaaaaaatgtagaaattttagcgcgtctcaaatgcatttttgttgtttgctcccagggagtggctttacttgctgtgccatgaaatgctgaatccttattacgggctcttccagtattctacggacaatatttacatgttgcaaataaatccggattcttcaatcaaccccgtaagtatgaatgaacaaagaggtagggaattgagttggagaagttttgagatggattttcagtttcattctcagtccttggtctatttgttgtagacttaatcaaagacagtggtaagcaaaacatggagaggtaaagtgaaaactgaattaagatggatgattccaatcctgtattttcagagatcgtgatcactgggtgtgctgtgttgaaggagatgaagggtgaaactgagctgttcatacactcacactttgtgatcatttgagggaactctggtgtgatgatcgtatgtgttaatggtgtcattctaaggagtaggttccgaagtccagcctcctcccggtcaaaactggaatctttccagaactagctttttaagccacaaatgctgccacccttagcgtgctggttttagagatgaagaagtcagtgcagtgtttgcacgcccagctcaagggtgggcagccggccagcaggggactcctcctgtggcaccacggccttcaccagcgtcctgcacaggccactgaggcgaagtcgggacaggctccgcttgtgcattcaaatgtggaagaaccttttaccaacatggaagcagagttttgattcattttttgaggtgaacataattcaaacctgaaagtagagacgtgtggttcctgagttaagaccagaacggctctggttctagaatggttcttttcttttttttgagagagagtctcgctgtgtcccccaggctggagtgcagtggcatgatctctgctcactgcaacctctgcctcccaggttcaagcgattctcctgcctcagcctcccgagtagctgggatcacagacccctgccaccaggcccagctagtttttgtatttttagtagagatggggttttgccatgttggccaggctggtctcgaactcctgacctcaggtgatctgcctgcctcagcctcccaaagtgttgagattacaggcgtgagcaaccatgcccggcctaggattgttatttgatttggcttactcatacatattttcctgtggtctttttctcccccttagcatttcttccctccctccctctctttccctctcttcctttcgttctggatcgagggagtggtggtggaggaggaagggaacttgcccttttctttcctgtgcagtgggaggaagcacagggctggcttcctgggtgcgcgtccagcatggtgccgaggccctgcagtgtcaaggccctgggcttggttcgattctctgttgtcacgaaggtgaaattctcagtcattgctgaacacggggctcctctgccagttatatggcccttctgaggaggtgttggccctgagagcatacaaaacgctgtccagcgaatctaggcaaatttctgctacacaagcagccttctttcacttgttcaggagcggggcctgtgagtccctgagtcagtaggtctggttgcctctgggacacttttcccaagaagcttggggacagcacgagattcccacattggccggcaccatgctgacaaattcgtgttctctggtgccccctacaggaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctgtaagtattgactgacggccggtcacctggcttagggcccaccaccacgtctatcgtatgtatgcgcgtgcgcgcgcgcgcgcgtgtgtgtgtattttggggatgtgtgtgaagccattgtattataacctgaaacaaaaaaaggggattttttggaaggcggaggcgggcagatcaattcagtccaggagttcgacaccagcctgggcaacacagtgagaccccgttactgcaaaaaaatacaaaaaaacccaccagatctagcaaaaagtactcagttgacttattttcctcatgatgttgggcaggtttctcttcatggactagtttcttttgtttccttgaatgaagaaggcgcgatcacagacgttaacaggccactccccaggcccgttgtggggtgtgtgtgagacactcagggcatctccagttaacctacacaggggccaagcaagtatcaaaacaaaattaacatttagttacctctgctttagaattattctaaacactctgttaagagcagcaggcagtgacaagatgaaccgtgactatcacgggtccttgcagatttcacggggacaaaacatcaggctctgacagatggagggaatgtgggtgagtcggagtcggggctcctggttgtgtcccatgtgtcacatgttccaacttgaacaggggactctggggatcaggtagaaaatcttccactcagctgggtgcggtggctcatgcctattatcccagcactttgtggggccgaggtgggtggatcacttgctcttttcacttgaggtcaaaggttggagtttgagaccaacctggccaacatggtgaaatcccgtccctactaaaattaaaaaaattttaaaaagccaggtgtggcacatgcctgtaatcccagctactcaggaggctgaggcaggaaaattgcttcaacccaggaggcagaggttgcagtgagctgagaccacaccactgcactccagcctggatgacagagtgagtctctgtctcaaaaaaaaagaaagaaaaagaaaatcttccactctgcctaggctcaagaacgatggcagattcaagagctagttttcactttcgagtacttttgtgtttgaactgatgcctttgggaaggctgcctctaagggaggaacagtatttttttttttttttttttttttttttgagacagagtcttgctctgtcacccaggctcgagtgcagtggctcaattatcggctcaacgcaacctccacctcccaggttcaagcaattctcctgcctcagcttcctgagtagctgggactacaggcgcctgccaccacacctggctaattttttgtgtttttagtagagatggggtttcaccatgttggccaggctggtctcaatctcctgacctcgtaatccacccgcctcggtatcccaaagtgctgggattacaggtgtaagccgctgtacctggccaggcacagtattttcttggcatggcttcatctccaggtcaatttccctttgaccctggtacctcttcacgttcctgccttttgactcccacactgcttacaaagcagctgggttgtgggtcccctgaaatcacaggatggtacagcaacctgctgcccgccttctatgactgtggaagccaggagccgggacatctggaaacagagctgtggtctcagggtcctccagcacctgttgctgtgccacccccacgcaggttctgtgtctgcccgaggctgtcctgtcttgcagccccgggtttggcagtcgtaaatgttttctgtctacccaatggccccgcgtggtggcagagttctaacctacatccttctgtcttatttcaacagagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggtaatgccacctgtcggggacggccaggtgcctggggcgcggctgagcctgcatttagttgctgtagctccttcgctgtgtgaggcctgcatgtccctgatggctggtgcttatgatcagatcacatgaacagaggcgactttcagaaaccgacagctcagcagcagcgtcagggatctgcttggaggggccctgatggggccaggcctggcctgagggacagagcccatgtggggaaggacttttcagtgaccacctaattctgggtgcaaaggtggggggcaaaggagagagcagcagcttggagggtctctcgtgctcagtccgaggaagccaccctctcagtttttttccacccctaacttgaggcagatctgtgttcaggcctaggcacttgcggcctaggcacttgcagctgagaactatgtgggcacgtctgtgtgccacgctgtcctgtgctgtactttcaaatgtacttttacacatttaaacaatttttaaatttttacatggtcttgctatgttgccaggctggtctcgaacccctggcctcaagcaatcctcttgcttccgcctcccaaggggctggcattgcaggcgtgagccgccatgcctggccagaacatgctttcacattgcagcaattgatgtgacagatcaggttcaatcctcctgttttcgcgagcaaatcggaatgaatcagggcacgtgctgagtcatttttaacgtgatgccaaggtttggtactactagctggtggtgtgtttgtctgtcttggagagatccggggagtggggggctcagtgtgttcccatgtttgtcagactgtgatatcagaacctgctcacaggtcgggcgcagtggctcatgcctgtaatcccaacactttgggagaccgaggcgggcggatcacctgaggtcaggagctcgagaccagccatggccaacatggtgaaaccccatctccactaaaaatacaaaaattagccaggtgtggtggtgggtgcctgtaatcctagctactggggagggtgaggcagaagaattgcttgaacccaggaggctgaggttgcagtgagccgagattgagccattgcactccagcctgggtgacagagtgagaccctgtctccaaaaaaaacctgcccatggcggaaaatccacttggtgttgcatccaacttgcgagtttttcttccaggttgtatgtaaactggaggtttatgagaggaatcgaagcccagttcttagctctgcagaaggggttcaatgagctcatccctcaacatctgctgaagccttttgaccagaaggaactggaggtatgtgcctgctgtgcggagtcgacccagggcgtccctgtggctggcgtctgcctgttttaaatccttgctgcagggggcagtgtgtgccgctttctagtaagcctaggagctgctggggttcccagactagagccagggctggagcaagagtggggagtagagggtgttcatgccagttagtaaccggcgagatgtctgcttggcggtaggaaatctgactaactcccgggaaactgttcaaggtggctgtggcttcccttgtttgcaagatctctagcaggggagattgcatagccctctcctgtcttgggagaaccaggttctcccacaagagcatcttactgctttttattctggctcttcctagcctaggaacaaggggctactgtcttctctagtcatactgcatgcacttgaacacggtgattcattcagcccttatccatctctggtgccaaatagctcaagccgtgtagattgttctccaagtctttctgctgccagtgaggagagcttgggagccaagagcttggatggagcagtagttctggggtgaacttttgtggttttttttttttttttttttgagacacggtctcgctctgttgctcaggctggagtgcagtggtgcgatcatggctcactgcagcctcgacctcccaggctgaagccatcctcccacctccgcctcccgagtagctgaggctacaggtgcacgtcatcatgcctggctaatttttgtatttgttgtagagacggggttttgccatgttgcccaggctggccttgaactcctgggctcaagtgatctgcccaacttcggcccccacaaagtgctgggactacaggcgtgagccactgcacccagcaggggttgaactttttaagccaattgcggaaacatgccctatcggccccagccccacctaactcttgctgaattctcctctcttcagacttgaaactccacatgtccttgagtgtcctggagagaccctgggacgtgccgttattcatggttagctctgttcagtgtcaccggttggttctttgatactcctcaccgatgcagagcaaaaaccccgctttggttataaaataacatcccatcaacagctgtgcaccgcggtccttggggttggagacccgtttggaggaggcggacggaagcatgtgccacaggcctcctgtttgtagctttcttcctgtctcaacatctgcctagtacacagctgctgctttgcttgggaatcgacttttcactgttgtgtgtcgggtacctaggaggcgcatcctgacgtgggtttatgcattttggaagtaattcacctttctgcacctcctcagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggtgactgacgtggaggcagggctattcgatgacgcgtctatgtgcgctgtgggcaggaagagctggaaggtggctgggatgtttttctgagatgtgtgctagaaaatggcataaggaatgttctccagtagctaatgctctgccctacagaggtggttacctggcaggggccgtgtgtgagcaggtgtggggccccgctgagcaaagactgtggagccactccagggcacctggattccccctcctcactgcttccaaaaagccaagagggtctggacagcaggggccttcagagtgtctgtgaggccagcttagccaagatcccggggagggagctatgggggaaccgcccccagtctcagtggctccaaagcttggagctgcacatgaacccgtttagccaccaaccacaccgaaagatgatgtcctgctcactctgtttaagccactgaggtcgccggaagtggggtggaattctgtgcgaaaggtgcccatctgcctgtagggcaggcggcctaatgtctcatcttttacacttagggtttggagggtacgttgctggaaggagtgaggtgagtgaagggtgtcaccatactgaaatttagctgattggactgtaaatgctgatagacacacagacacattgtaaacacagaatattccctctgcctcgctgagtaaaatgaggttaattccatttcagtcggctttggccatcagggcacctgcatcttttccattgtgacctctgcctatagatttgctgctgggggcccagcatggataaaaaggggtttgaggctgagccccgctcgtatctgggagcctctgtctgcctgaccatgacagctgctcccagagcttgctggtgcctgtcatttacaaagcctttctcattcagttctcccaacaaccccgagagcctggctgatggggattattagccccattccatggatgaggaagccgagactcactgaggtcatgggatttattatccccccgaggaaaaaaaacaggaggtgtgagtggggaggcagggcaggaatccaggcttcctgaccaagtcacttttctcatggcgccattgtcttgcccacagcaggtccacatgctaaaccttcctgcttagagatagtccctgtcattgtaagggtctcattagtcctccaataattggatagactttagcccagtgtcctccaagtgtctagaaggtgggtcagaggtgaccagggtcacagtcccgaacagggagtgctggtgctgtgggagggcactgaatggtggcccgggcagagtggccagggccctgcaggaggtctctgaaggccctcacctggcccagcctgtcctgactccccaggaggctggggcttggagggtgtggcctgtgagggggaggagccagcttcctgtcccaggaccccagaaaccaggggctgcacactgagaccctctgcccaacataaagatggtgtctctgctggtcctcattgctcccggagtcctgtcctgccactgaccttggcccagcttgaaaggagtatctgtgaatacacaggagcaaggggcagcagagccaaggcccgtgccctctgcgccctcctttcccagcacctggcacccctgtcagctagccgtctttgcagcagcagtggtggctgctggccagcctggtgctcacttggggctgagtttggaaacacctgagcaagaaggggcctggtgcctctccctgccctacagaactggtgggcaagtcgtctattccagagggtgggtacaaatagctctgaccctcagggagcctgtctggagcaggcccatggtcagggtgcactttagggggggccttagcagtccttgctctgccccctgcgatattctaaaatgttggcatcttggctgagtgtggtggctcacgcctgtaatcccagcactctgggaggccgaggcaggtggatcacctgaggtgatccaggagttccagaccagcctgggaaacatggcaaaaccccgtctctactaaaaatacaacaattagccaggcgtggtggcatgtacctgttatcccagctactcgggaggcaggagaattgcttgaacccggcagtcagatgttgcagtgagccgagactgccccactgcactccagcctgagcaacagagtgagaccctgtctcaaaaaagtgtctgaattttgtcactttgatagccattgcaggcatgtcctaaaaccaggcctgggaacctcatggccctctcacaggacagcctgcctgggtgtgggggtgggaatgtggtcagggccctgctcctgggggctgtgtggccgggaagcgccacggctgtaactctgaagtacattaactagaatgttgtcttgtaaggttctacaggcgcggcagggccccggctgttcaccatccacctgatagacgcgaacacagacaaccttccgaaggcccatacctggtaagcaccgcggccaggaagtcacggcgtcctgggagccccagaggatgctgacgttcacgttttttttttgttgtttttttttgagatggagtctctgccaaaatatttttgtcatcatcagaactcaaaagccacagcacctgagacagaaggagaaattctagagttgaatgacaattctgaagccctcaagcaagagactttccccccgacattacgacactgtatagagcggctttactggccatgtaaaaaaatacctgtaagagggccaacattattgctaaacttaacatacatctttcttacagtatatataacctaaaatttaaatatagattttctcttgatttagttttttgtttttgagacagtcttgctttgtcactcaggatggagtgcagtggcacgatctcggctcactgcaacctctgcctcctgggttcaagcaattctcatgcctcagcctcctgagtagctgggactacaggcgcacgccaccacacttggctaatttttgtatttttagtagagatggggttttgccatgttggccaggctagtctggaactcctggcctcaggtgatctgcccacctcggcctcccaaagtgctgagattacaggcgtgagccaccaagcccggcctcatgttattttttaaagctgttttccgatttgtaggactctgtttcatttatgccaattctcaatgactggcagtagtgcttgtgtcagatgggacaagtactttgcagcgtcccacacaaaggttgtcagagtctcttatgaaactaattttgttatgagccatgtaattaattaatattggtgtttcagtggagtgtggctaccactccagcaggctcaagtcttcctctctgccaggtcttatgtacacacacctgttggtaaggaaaattgtatagtttttagtttggatgtattgggcttcactttatctgacatttctgggtccccatcttcttggaatcctgcttatgacacacgtaccttgtctattgcaaatgttttcttcctaaattttaacttaaaaacgagtctccatagtagattatttcctgtatggtttacaaatacaatcacttgcgtacactttgtcctggaaccatccattgagacgagtagccacatttccttgggggaaccagttctagatgctgctgagatgccccgtgagatgatggaaggttcctgtcttggaacccaaggatgcggggtcagatgctagctgtgacaccctctgacatgtgatttggggcaagtgacttcatattctaacttggttttccacacctgtgaaatggggtaatgcagctggtcctggaccatggtgggtgccaaggtcctgctccaagcatggctgtggcgtccattacgggaacgcaccatgttggctgcacaccctactcacaaggcttttgtcctttagtagtttagtgcttggagttagatggatgtggaaagtatgctctgaagctccagaaaaaagagtgcccgccctggaacccagctctgtagagacagaaaccatccttaattgcttaccctagaaagccagaagtcactgtacatcctctgggtcacaattttgtattttttggtttgctacgatagcttcttaaaggatgtctttttctttgcacaaatactggaaatgagcttccccctggaaatatcgagtcagaagttgaatattcatttcatcttttaaggatctgtcatcttgttagttttgagatctattttgtttttgcagggaattttccagactgccctgttttggtctcagatcaagtcccagaggaacagacagacacgcagtacatcgttagtggtgacgttgcctgacagccagtctaggttacaggggctgccaaagaggcattcccagtacagagaaagaatttctcccaaagacagacaaacagaaaacaagtggagagctttgtcctgatagaagcagtaaatagtaacttggttatgttttggttgtgaaggcccaagacttactttactgtgtgttgattgggcacagtggctcccagcacgttgagagggcaaggcaggaggttcacttgaggccaggagtttgagagcagcctgggcaacctagcgagaccctgtctctaccaaaaagcaaaaacaaattacaaatctttgtattagaagcagaaaaacacaggggacatggagaactcatcaccaaccctgccccaccccccattcctctcccctcccacatatacttctcactgcctgtccttggccttgaggttggtcctagggctggactgcccacacggtgactctcttttgtcctttttcagctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgactttacatttttggcgtctgttattttggtgtggaaatgagattctagtgtctttgcaaacccacaagaaaggaagtgtgtaggcagcaggaatactggcaagggccttccaaggaagaaggacagagataaggatagaattgtaagggaaactaatggcaatatggtagtgggctgaaagtgctctatcgggaaaaaacatgggattgagaaaatttagaatttctttgcgcaccggttatcttttcgttttttccttttttttttatttttttgagatggagttttgctcttgttgcccaggctggagtgcagtggcgcaatctcggctcactgcaacctccacctcccaggttcaagcaattctcctgcctcagcctcccgagtagctgggattacaggcttgcgccaccacgcccggctaattttgtatttttagtagagatggggtttctccatgttggtcaagctggtctcaaactcccaacctcaggtgatccgcccgcctcggcctcccaaagtgccgggattacaggcatgagctactgtgcccagcccttacttttttaaaaagttgtagtaaaaatactgtcagccctacataccagtgggttccacatatatggatccaactggggatcaaaaatatttttttggctgggtgcggtcaggagctggagaccagtcccagcttcttgggaggctgaggcatgagaattgcttgaacctgggaggtggagtttgcagtgagctgagatcacgctactgcactccagcctaggcaacacagcaagactgtctcaaaaaaaaaaaaaaaaaaaattttttttttaaatggatggttgcatcagaacatgaatagatttttttttcttttcattattccctaaaccatacagaataaaaactacttacatggcatttatattgtattagaaattataaacaatctagagatgatttaaagtatacaggaggatgactttttttttttttttaaaaaaaagagtctcactctgtcacccaggttagagtgcagtgacacaatcttggctcactgcaaccttcgcctcctgggttcaagcgattctcccgcctcagcctcccgagtagctgggactacaggaatgcgccaacatgcccggctaatttttgtattttcagtagagatgaggttttaccatgttgcccaggctggtctcaaactcctccacccacctccaccttccacagtgctgggattacaggcatgagccactgcacctggcattactgacatcttaacaaagttaagtcttccaatctatgaacatgggatgtcttttcaatttacttaagttttctttaacttctttatacaatattttgttttcggcagacaactggcaagtcttgcacctgcatggttagctttattcttttagatgctattataaacataattgctttcttaagctcttttgtggacattcattgctagtatatagaaacataactgcatttgtgtgtcaatcttgtaccctaaaactgcaaaaattcgtttcctggctctagtggctttcttgtgaattctttgcaattttctatctgtaggagatagctttaccttttccttccaacttggatgccttttattttttatctattagctctggcttatactttccagtacaatgttgaatagctgtggtaaaagtgggaatttttttcttgttcctgatctcagagggaatgtttataagtaaaatgcccttctgtatcagttgagatgtacatgtttttttccctgtgttctattaatgtgatgtgttacattgattgatttttcttatgttgggccacctttcccttcctgggataaattccacttggttgtggtgaataattcttttaatatggtcttggggccgggcgttgtggctcatgcctgtaaccccagcactttgggaggccgaggtgggtggatcacgaggtcaggagttcgagaccagcctggccaacacagtgaaaccttatctgtactaaaaatacaaaaattagcctggtatggtggcacacgactgtagtcccagctactcaggaggctaaggcaggagaatcgcttaaacctgggaggtggaggttgcagtgagccaagactgcggcactgtactccagcctgggtgacagatcaagactccgtctccaaaaaaaaaaaaatgctgttggattcaatttgctaatattttgttgaggatttttacatctatattcataacagatattggtctatagttttcttgtagtgtttttgtctggctttcaaaaatcaccgtaatgctagtctcatagaataagttaggaagcattctttccttttcaactatttggaagagtttgagaaagactggcattaattctgctttaaatgtttgctagaattcaccagtgaagccatctggtcttgagcttttctttgttgggacgttttagatttttgattcaatcttcttactagttatcagtctattcagattttgtttctttatgattcggtcttggtaggttgtagagttctaggaatccatttcatctaggttattcaatttgttggcatacagttgttcatgatactctacgatcctttatatttctgtaacattggtaataatgtcccctctttccttttagctgattcttccttcttaatcatctaaagttttgtcaatcttgttgatctttttgaagaaccaactcttagcttcactgatttttgtcatttgtcttttatttcctctgctatagtatttattttcttctgttagctttgggtttagtttgttctttttttcctaattccttcaggtataatgtaagttgttcatttttaaccttctttttaatataaagatttacagccataagtttccttggtcatggtgaataatccttcttagcactgctttcgctgcattccataagttttggtatgttgtgttttcatttgtctcaagatattttctaatttcccttgtgatttattctttgacccactggttgtttgaaagcatcttgtttcatttccacatatttatgaatttcccagtttccttctgttactgatttttagcttcattctgttgtggtcagagaaaatactttgtgtgacttcagtcttcttaaatttattgagacttgttttatgacctctctggagacagtctattctggagaatgaatgttccatgtgtatttgagaagaatgtgtactctgctgttgggtggagtgtttgtgtatgtctgttaggtccagttggtctacagtgttgttcaagtcctgtatttccttattgatcctctgtctagttgttctattaataatttattgaaagtggggtattgggctgcgcacagtggctcatgcctgtaatcccagcactttgggaggctgaggcaggcgttcacttgaggtcaggagtttgagaccagcgaaaccccgtctctaataaaaatacaaaaattagccaagtgtggtggcacatgcctgcaatcccagctaccctggaggctgaggcaggagaatcagttgaacctggaaggcagaggttgtagtgagccaagattgcaccactgcactccagcctgggtgacagagcaagactctatctcaaaaaaaaaaaaaaaaaaaaagtggggtactgaagctttctactattatagtggagctatttcacccttcgcctttgctgtgagcctctctgggtttatcctagctgaaatttgtcaagcttcttaaatttgtatgtccatttctttcttccaatttgagaaagttttgtccattattttttcaaataagctctgtcctcttcctttcttctctttctggaatttcctaaattggacctgtcctaaatcggacaccttgatgtgttccataaatcccttgagctctcttcattttttctctttgctcgtccagttcagtgatttcaaatgatcagttttctaaggtgtctgattctttcttttgcctgtttgagtctggtgttgaaccactgtattgaatacttcatttattgtatttttcagtgccagaatttggttcttttagataatttctatttttggttgatattctcattttgttcatacatcactatcctgatctcctttaggcctttgtcgtgttctcccatagatctctgggcatattcaagacaactgttttaaagtcttttctaacaagtctgatgcctttgtttcttcagggatggtttctagagatatattttgttcctttgaatgggacatgttttcctgtttctttgtattccttgtgatttttttttttttttttaaactgggcattcgcaaaagcagtcatctcttccagtctttgaagagtggtggggaaaagcttcactaattcagagggtatatcgtaatagttgctatcagcctgaggcgacagcttaaggtcatctcaggtcttttaggggcctctgtttttctttcgtttataccatatacatggctgcttttcaaagtcttaatttttagccaggcgcggtggctcacgcctgtaatcccagcactttgggaggccgaggcaggcagatcacgaggtcaggagatcgagaccatcctggctaacacagtgaaaccccgtctctactaaaaatacaaaaaattaactgggtgtggtggcgggcgcctgtagtcccagctactctggaggctgaggcaggagaatggcacgaacccgggaggtggagcttgcagtgagccaagatcgcgccactgcactcctgcctaggcaaaagagcgagactccgtctcaaaaaaaaaaaaaaagtcttaatttttcaaagggtcttaacccagctgcttcttaggaataagatgttctcttatattttctgcccataatctcttgccccaggtatccactgtggtgcccctggcagattttacatgtcgtacctgccactgccttccatggctcttgccagcctgagatctgaactatgccaccttccctgtttcacctctgagtcagatgacatagaaaccagtccttcaggtagcccaaagacagggcagaacactgcaaatcagttctgctctgctccctccggtgcaagggaagacactggaaattgggctgcttcctcccaaacacccagttgtgccagggaggaatgggggaagggcaaataaaaatgacataaaaactattttcaatgtggctttttcttgattgggtgttcagctggttgctatagacctttggctggttcccagagctcctagtgagtgcctagttgtttttttttcccctcaatgtttccttggggaaatgtgggcctggagcttcctggtctgccatctccaatctctcttgattggagaattcaatccattttacatttaaagtacttactgataagaagggacttacttctgccatttaaacttttttttttttttggttcctcatttcctccattactgcctttcgtgtttagttcattttttatagtgacacggggattacacttgacatcctaacattacaacaacctaaatcgaatttatatcaacctaatttgaataacatacagaactctgctcctgtactgctgtctcccttactgttactgacatcacaaattacatctttatacgttgtgcacccaatattagcagttgttaatggatctgtctttttaatcatgtagaaaataaaaagagttacaaaccatcattagaatatactagattttataactgtccatgtatttacctttactggagatctctatttcttcttacaacttcaagttgtaagatgcttagtgttcttttaaagaagtttatagtgttcagcgtttcaacctgaaagactccttctagcatttcttgcaaagaatgataatgaactccctcagcttttatctgggaaggtattaatttcttcctcatttctaaaggacagttgttagatgtagaattctaacaggttttctttctttcagcagttttcatatatgagcccattctcttctgattcccaaagtttctgatgaaaaatatgctgataatcttgagaatctcttgtatgtgataaattacttctctcttgctgctttcaaggttttcttttgtcttcaatgaagtgtcttggtgtgtgtttccttgagcttatcctatccagagtttgttatgctaattgggtttgtagatacattttttttttaatcaaatatgagcagttttctgttgaactttctttaaatatactttctgcccttgcctctctacttctggtctcatttatggcattccataggtaggttccttaggttttcatttactttcttcattttttttcttttgattccccagattcaacagtttcaattgccctatcttcaagctcattgagtggttcttctacctgcttaaatattttgaaccctttagggaatttttcatttcagttattgtactttttatagttccagaatttgcttcctttataaaatttctatttattgatattctcattttgttcatatactgttctcctgtctttgttttcctttagctccttcagcatctttcaaacagttgttttaaagttactgtctagtaagtctgctgtcagcgcttcctcagtgatggtttctgttgatttgtttctttgaacgtgccatacttttctatttctttgagggtcttgtgattgtttcttgttcaaaactggacatttgaatcttataactctggaaatcagattctccttttttcccccccaagcatttactcgtctccccacaccaactgttgagggtatctcaggatcagcttgaggtgaaagcttaaagtcttcccaggtctcttctgagcctgcatatttctctaggtatgtggagtggctttctaaattgccctgtatacacatttatttcacagttgatttctctgctcagggactcacaaggctgcgatcaaggtgtcagccagactgtattctcatctctcggctcaaccagggagaatcttcttgcaggctcctccaggttgttggcagaattcattttcatgtgactttgtgatggagggacctggcatcttactggctgttggcaggaggcccaagtaagttgtccgcacatgtgcttttcaatatcctcatccttaagtctggctccccaaatggaaaaacaggtaagaagaaaaacaatagctcaggctgttcccttaaatcctctggaagccacttcagccagtggggaatgcaacaatggctacccacctctatgtttgcacttctgcaatcaaaacactgaaccttgatacgtggaggccagatccttacttttcaccctggctccaggaagtcatgccaggaacacgggcatggctgcctaccacaagactcaggatggggagacgctaatatcctaaaggctgaaattgaccgaaattaactgcaacttaccagccaagattttccttggaagttgcaagcatccaaattagactccagagttccaaaacggttacctcagacagattctgccactccaatttttgtctcggtgcggagagagattccttcctcttctgtccccttgctggatgtcactcttatatctttttttatttctcaccctggcacagtcactagaatgcagtgtgtgtctgtaagcttagccagcagacacagtcctgcgctctgatgtctgtgagaggatgcagcactctaggttagggaacgtgtgtctggcttgttggggcattttctactgtcaaaagtcggagtattttcaggttttgatctcagtgtcatcactaggtagttggggctttaaacaagttggtaagcctatctgtgtgcccacatctaccgtgtctactaccttgatcacttttctttttttttgagacagggttttgctcttgtcgcccaggctggagtgcaaatgacatggtctcggctcactgcaacctccgcctcccgggttcaattgattctcctgtctcagcctcccgagtagctgggactacaggcgcctgccacgacgcttgtctaatttttgtatttttagtaaagagggagtttcaccatggttggccaggccggtctcgaactcctgaccttaggtgatctgcccgccttggcctccaaaagtgctgggattacaggcatgggccaccgcacccggccaatgacttttttaaaacatgctcttttgaaactctctcgtttgttctttcatcttcccttccaccaccataagcactgcagctccctcaggaagccatagcatccttgtcttctgatttttacctgatgatcatatacagatatatatgtatacatattttttgtgtgtgccgatttttttccatgtctatgctctcaagaggcaggatgactttgttgagagcagagctaggatgtaggatcaaggctttataacatgaccttgaatattaccctgataccaaagccaggcaccaggagaaaactacaaactaatggcccctatgaatactgatgcaaagattttcaacaaaatactagcaaaccaaatccaacagcatattaaaaggactatataccatgataaattgggatttattcctgggatgtgcaaggataattcaacaaatgaacaggataaagaggaaaaaccacaaaatcattttaactgatacagaaaagcatttgacaagatgtatcaccttttcagataataacttcttccagcaaactaggaatagaaggaaaacacctcaacataataaaggccattatgcaaaacccagagctaagatcatactcaatggtgaaagactgacagggcttcctctaagataaggaatgagacaaaggtgaccgttttttgccacttgtactcaacacagaagtggaaattccagccagaataattaggcaaatggggaaaaaaaatccaaattgaaaaggaagaggtaaaattatctgtttacagatgacatgattatagaaaagtctaacgaaaacaaactattagaataaacatatttagcaaaattgtaggatacaaaaatcaacatacaaaaatcagctgtgtttctatacactaacaataaataatccaaagaggaacttaagaaaacaattccatttacagcggcattaaaaagaataaacaggaacacacttaaccaacaaagtcaaatacttgtatactgaaaactgtaaatcattcattaaagaaattatagaagacgggccgggcatggtggctcacgcctgtaatcccagcactttgggaggccaaggtgggcggatcacgaggtcaggagatcaagaccatcctggctaacacggtgaaaccccgtctctactaaaaatacaaaaaattagccgggcgtggtggcgggcacctgtagtcccagctactcgggaggctgaggcagaatagcgtgaacccaggaggtggagcttagagtgagcagagatcctgccactgcagcccagcctgggtgacagagcgagactctgtctcaaaaaaaaaaaaaaagacattccaagcttatggaataaaagacatactatattgtatttttaatttttcatttttttttgagatgttctcccatccaggctggagtacagtgctacaatcatagctcactgcagcctccaacttctggggtcaagtgatcctccttgctcagccttccatgtagctgtgactacaagcacacaccaacacacccagctaatttttatatttttggtagagatgaggtctcactatgttgcccaggctggtctcaagctcctggcctcaagcaatcctcctgcctcagcctcccaaagtgctgagattacaggtgtgagccaacacacctggccaaaatattgttaagatgtcattactactcaaagtgatctatagatgcaatacaatcactatcaaaatcccaacattgggctgggcgcagtggctcacgcctgcaatcccggcactttgggaggccaaggcgggtggatcacctgaggtcaggggttcaagaccagcctggccaacatggtgaaactccatctctacaaaaatacaaaaactagctgggcgtggtggcatgcgcctgtaatcccagctacttgggaggctgaggcaggagaatcgcttgaacccaagaggtggaggttgcactgagccgagatggcgccactgcactccagcctgggcgacacagcaagactccgtctcaaaaaaaaaagaaagaaagaaagaaaaaatcccaacattttagcagaaacagaaaaataaatcctcaaatttgtatgaaattgcaggggaccccaaatccagaacaatcttgaaagagaagcacaaactaagagaacttacacttcctggtttcaaatcttactaaaaagctacagtaagcaaaacattgtagtggtggcataaagacagacagagagaccaactgaacagaacagagagcccagaaatcaactctccacaccatatgcgtcaactgattttgggacgccaacaccctttccaacaggatcgtcttctcaacaaaattatgttggaaaaaccagatatccacaagcaaaagaattcagttgggccctcagcttatagcatatacacaaattaacttcaaagtggaccaaagatctaaagtaagtgttaaaactataaaactcttagaagactacataggagaaaagcttcatgagattagatttggcaatgattttttgacattacatgaaaggcaaaggaaaaataaattgaactgcatcaaaattaaaaacttttgtgcatcaaatgacactatcgacagagtgaaaaggcaactcacacaatattagacattatttgtaaaccatctatctccaagggattactatccagactatataaagaactgtaactcaacaacaaaaacaactcaattgaaaaacgggtaacggactagaattgacacatctccaaagaagatatatgactggctcacaagcatatgaaaagctgctcaacttcactcatcactagggaaatgcaaatcaaaaccacagtgaagtaccacttcatgcccattaggatggatgtcataaaaaaaaaaaaaaaaaaaaaacccagctgggcgcggtggctcacgcctgtaatcccagcactctgggaggccgaggtgggcggatcacacgaggtcaggagatctagaccatcctggctaacaaggtgaaaccccatctctactaaaaatacaaaaaattagccaggcgtggtggcgggcacctgtagtcccagctactcgggaggctgaagcaggagaatggcatgaacccgggaggcagagcttgcagtgagctgagatcgtgtcactgcattccagcctgggtgacagagcgagactccatctcaaaacaacaaccaccaccaccaaacaaaaaaacagaacattgcaagtgttggcaagaacgtgaagacacagaaaaccttacctattgctggtgggaacgtaaaatgatacagctgctatggaaaacagcatggcagttcctcaaataatgaaagatagaattcctatatgatccagcaagcctacttctgggtagataaccaaagaactaaaagtaggaaattgaacaaatatttgtatgcctatgttcagaggagcattattcatagtggacaaaagagagagaagccaagtacccatcagcagatgaacgaacaaacaaaatgtccacacaggcaacgcaatgcaattcagccttaaaaaagtaaggagagtctgacacgctgcagcatggatgaaccttgaggtcattatgctaagcgaaataaaacagtcacaaaagcctgggtgctgcggctcatgcctgtaatcccaacactttgggaggctgaagtgggtggatcgcctgaggtcagtagttcaagaccagcctggccaacatggtgaaaccctgtctctactaaaaatacaaaaattagccgggtgtggtggcgggggcctgaaatcccagttactcaggaagctgaggcaggagaatcgcttgaacctggaaggcggaggttgcggtgagccgagatcgtgccactgcactccagcctgggtcacgacagtgaaactccgtctcaaaacaaaaacaaacaaaaaacagtcagaaaaagacaaatattgtatgattccacttacatgaggtccctagagtcatcaaattcacagagacagaaattagaatggtagttggcaggggcggaggggagggctgatggggattgagtgtttaatgaggacagatttttccagatgggaagatgtaaaagttctggagatggatgctggtgattgctgcacaacgaaggtgcataatgccactcaactgtgcacttaaaattcatcaaaatggtaaatttgatgttatacatatcttaccccaagaataaaaagaagtctgatcatagcacttaccttgaaatggtgtttggagaaaaagggcatattgtctgcatggtctggaccctcctcactctggagccggcagcctcccgggtccagctcccagcaatgctgtgccgggtggacagagctgaggttcatggtcactgagttgctgcctgaagggctccagactccagatccttgatctttccacgtggagctcatgagagctcctggatcttcaccggggaggtgctatctcctgccttggccattccaaggttggttttcccaacaaccagggggaaggtgtgggcgaacctggcagcaggccgggcctcttcctcaccagtagcaccagctccagactcccattctccagtgtgaaagacaaatgtcccccaaccctaacgccacccacacatctgcacagacaccaggcttcatggagcgcaagacgactcacacagtggcccaggccttgtcacacgcagtgaggacaatcagaggagcacggtcaccgctcaggcctgatgccagcaggacacccaccagctgccagatgagcacgcaatcactcctcatttgcaaagcacggctcccatcattccagaacccaagacactgtctcacaaagacagctctctgcaaggaactgggaagtaacttgagtccagtcagaccggcaaaaatcagtccctcggccttgacctgtgagcagcatgtgggcttggaatcaggctggacgggcttccctcccagtttctccacagctgctccaggcctgggacaagcttctcaccttctgtgagctggaaaccccctctctataaagtggggaaccacccctctgggctgagggctggagcccagcacagagaccttgatggtagctgccagtaccgcccactgcaaaccagcctgcacccaggccataacccagcaacacaactgcgatctcaagctgccaagggacatcttgtcaaggccctttcatttgaccctgtggtgggatttgggtaaactcagctgtaatcatcattccgtggtagcctggaacaatggagggtaaatgaaaggcaaggagagtcaagggctggagaaggttctgtggcctgcggcagaggtccagagagggctccgtgctgcccccgtcccctggggcctgtaaagggccatcttcctcgaagaagatgtttctgacatcatggcgtgtgctccttggggactgcccctcccacacgagggcaggcctggctgaaggtacacactggatgaaggacaatgaggaggtagagctgggtacagagtgcttcatgctgagcctccgggcatgcttcgtgtacactccgcacactctccacacacacacgttacatggcagcagtcctgaaacacatgaagatagctgagggctccgagagtctggcatgccgacccgctgctgagatcaggccgccattctgagagtcccgcacgccgacctgctgctgaggtcgggccgccattcctcatcaacttgactgaatatgctctgagctggcttcccaggtgccaagtcatggcctcccctgtgatcacagcagcactgtgcctgcccaggcagcgcacgctgtcaccaagaggctacgctgaggagcccacactgtctctggggcctctggttcccaaggggctagggacattgagagggaagaaacccctcatggaaacaagcattttaacataaacaagggacaataaacccttttataaaatatttattctaaaaaaaaaaatcacactgtacaaatttagatagaacattatcaatgctcagatttataaaaatgggaacagaaagactaaagctagcgaaggaacgtacatttctgttttgtctttttaaattaggaaggtaaaagtgattttttcttcaggtgcagtgatagtaaatgtctagaagacatccgaagagccagaaataaaaagcacaggagccgcctgcagactctcagagttctgtcttcacccactgaatccgaagtggatgcgtgtggcgctcccgcagggtggcctggccccgtggatccacgccgaacgctcaacgagattcccaaggctggctgtgtacagcctaaaactttgtgctcagagaaaaaccagcatgatgggttcatcaactcctgtttctcaaacaaaatgagttttctgtacacttgttacaaaggtctgtacaaaagcacgaagctgctgtgaggtgttatttccgaaagagttaaaaatggatggaagggagctgttcgtacagttccgcctgtacattcacagagggaggacaccataaaaaaaggactcactcagaaattccagaccggagaatcctggcttcttaaaagattattttgaaagcttggaataagtttcagctctgccatttccaaccgcttcgcccagcatcgtcatagttcagcttcctctaaaactatattctccctttcttacacgcaaactaccaggaaaataaccgcaacccagtgaaactatggggcttctgtgaatataaggaacgaggcagggagaagtcgtaaaagctgcgggctcagagcccggagcgcccttcacattccgggtggccgtggcggccacagtcacagccaggggtgccaggcggggtccatgcggcacagattgtccaggctgtttgccgcggccaccagggtgttcaccttgctttccccgccttcgaactgggcgaggttgtgcaggcgggtcatgatggcggtgacggctttctgaaccagggacaccagttgctggctgtccatgttctctggctgcccggcggccgagagaggagaggacgtgtcctcttgtgtttttttgtgccaagcaatgatctcgtcccggagaaccgttttcagaatgccatccacctgcgtgagggagagaacgagacgacttgtgtttaaccaagaacagcccacaggggcagcttcctaacaaggtgggactcaaccacagcggccgctcagggccaccaagggccagtcgagtttcagcaccaggccaggctgtgtgccctcaggacgggctggggaagccgctgggggacaaaccccttcctccacttggagcagcagccagaaggcctcagtgttgggcagcgcggacctagatgacaaaggcagccatgctgcgactgaggcccaatctgtttatttgttcacttgacaccttccggcatctgccgagtgtcaggcaggcccgttccaagcactacagacaagagtgaaccaaagagaaaaccatcccttgccctcacagcaaaggacataacacacaggggtgctggccactgtggagagcgcagagcccgtgaggcacatcagcagctcctgcaaggccgtgacgcgcgggcatctgagtggctctagcctgcgcctgtgataggacgacgtggagacccaccttaaagtttggctgggcgaagcaccgggcgaccgcaatcatggacgctgtcaacgggccggagaccccgatggtggtcagaaactcagaaatgttgggcgtgagtcgaaatgggacaggacggttggcatccaggtctccagtcgcgtcgtttatgtcaaatcgaaagtaggcaacattcagtttgccagtgtcctaaatttcagaaggagacactttaggaacttcagcagaaaggcgatgtcacgaggagaggatctggctgttcaaagcaggttacctgagcgatctgtaacatctcggggttgagtctatttaaatgcaggacgaattccgcgaagcctatcagagccagctggatggtgaacatcttccggaacgtccagtagtccgtggcattggggaaggtgtgcagcgcccactccttgagcatgctgcgcggcaccatgttactctgaacctccttgaggatgtcgcggaggacctgaaacacagcgctccgtgacactcccatctcactcactgattttttttggaaaagaaaaattctcaaattgcaattcctctttaacttagcaccaagagcaaattctgtaaattctggtgacagatttaacgcacgcattgttaggagactgaaggcgaggaggcacaagatggctgtttccctccagggttcgccactgtctgctctaaagcaccaatgcggctggtctgcgtcaaagctgcagttacctaatatgcgatacctgacaagaatgcaggtaaatatctgaacatttccacccttgctgactatggaatatatcaggccaattaacagaacacaacagctggacaacagcagcaccacttccaaccaagactttatactaatgacagatgtttcacaaactgaaggagctggtctaaccacacacaccacacgagagactgaactctgtactagagactcatagactactgcagacatcaccaactcagtaagagttcactcagttaatggacttcccgttcgaccatctggtacaggccatctacggggtcttttcccagcttagtcctacccacgtgctctgtgggaatggctgtgagaaagcaggcccttctgccggcaagaacaagggaggccaccggcgacacatgcagtttgtttgtttcctcatccgtcaaatgggaagaagcacttctgagactgcaaaggagttccaaaatctgctccttaagcagtgagaatgctggcaaaaccatcaaaatcaactttgtcagaactctagaaattaaaggcttacaacagtctggaggagcttttttatttagttaaaaaacaaaacaaaacaaaaaagcctgggctgggcgtggtggctcacgcctgtaatcccagcgctttgggaggccgaggtgggtggatcacgaggtcaggagttcaagaccagcctggccaacatggtgaaaccccatctctcctaaaaatacaaaaattagccaggtgtggtcacaggcacctataatcccagctactcaggaggctgaggcagaagaatcgcttgaacccaggaggcggaggatgcggtgagccgagatcgcgccattgcactccagcctgggcaacaacagcgaaactctatctaaaaaaaaaaaaaaaaaaaaaaaaagagaagaatgaaggagtagaataaataacaaaataaacaagaggaggaagcggctctgaagctggattcctctgtgctgtgggcatctccctctgcctataggccctggcagctgctaagctggaacaaactgcctagtcggtcactcacgctgtttagaaacaggatgactctgaggtcagcatgtatttgtcactggcttccacgctgtcgaaagttaatgtcgccttaagaatataatccattcctctcctgcaaatacctcagaactgcccatcatccacagaatgaccaggccatggcctgtgccacaaaaaagccctggtgtcaattcccaagagaggccatgaactctgtcaacagaggctgatcagaaacagggatccatgcctctgcctgcacagagctggaggctgcacctgatgctgcagcctggaatacctcgggccctgccgtgccctgggccacagagtacaccatgggctcaaccttcctcaaccaaactaagtcctccaggagccaggagaactggaacaagtccctgggtgactcgggacaaggtcacagcatccacctctgtggtctctccttcttgggacccatagaaaggaccacggggcacccagggagaggccaaaacagctgcccctgggtgccccacacaatcccccaaaaatctccccacctaaagcccatacctgccctgcctcctaccaagggcaaaaacgtgcaggtgaatgaggggcctctgtacctccgaggggctgcaggccagggccacccaagactcctgcgggcaccatgctccgggctcaggcaaccgaaacagctgggccccatgcactccagagtctgtcgctttttgtattttagaaaacagcacacatgctgcacatcgcctaacacctccagcagcagaccaggtgaacaggaacatgaagtggatgaatgaagcctataaacagcctcccatcacctcagatcaggtgtggctgtcaagtgagcctgccagaaacttactttaaaattctaatttcggcgcttctttgtaagtacaggcagagggcaaggggcctctccaaggtcgaggactgacccgtgtctggtcataacaaaccgtccacgacaagtgtcctctcaccaaggtcaatagctgtctcatttccaccatctcatgagtctaataaagttactttaaatgacagaggtggcccccaacaaatgcctgttcatctcctaaacacccctgtctccaggcactgccccacacaggagggctgcaggcggcagctcggcccccggcccggccccactgctacctggtggctggcttgggttccccgcgcctgcaccgtagccagccggtcatagtaacgggagatggggttgtcatgctcgatgcccttcttggcgcagcgctgcttgtagatctccacaagggaaagtgaagaggggttgtcctccacgaggcgcatctgtggggaaactgccacaacccggggcactggggagagaggaagagaaacggggcaggctgagggtgaccgcgggccagtgctcagctccaccgtcagagtgccactgggagcagagctgacccggctctgtatgccttgggggcttagctggaagaacccggtggtcatgcaccatccatttgctcaacagatggcatgaggctctgacggcacgaactgatcgtcaccttgtgtccacaaacagaaatgctttagaaggcaatcttaaaaagacatcttggccggacacagtggctcacgcctgtaatcacagcactttgggaggccacagtgggcggatcacgaggtcaggagatcgagaccatcctggtcaacatggtgaaacctcgtctctactaaaaatacaaaaattagccgggagtggtggcaggtgcctgtaatcccaactactcaggaggctgaggcaggagaatcacctgaaccagggagtcagaggttgccttgagccgagatcacgccacagcactccagcctggcgacagagcgagactccatctcaaagaaaaaaaaaaaaaaaagacatcttaaaaaaacaaaaaataaaggatagcctatagtcccagctactcgggaggctgaggtgggagaatcgcttgagcccaggagttggaggctgcagtgagctgtgactgcgccactgcactccagtctgggtgacagagcaggaccctgtctaaaaaataagaataaacatggctggccatggtggctcacgcctgtaatcccagcactttgggaggccaaggtgggtggatcacatgaggtcaggagtttgagaccagcctggccaacatggcaaaaccccatctctactaaaaatacaaaaattagccaggcgtggtggtgcgcacctgtagtcccagctactcgggaggctgaggcagaagaattgcttgaacccaggaggtggaggtggcagtgaactgagattgcgccactgcactccagcctgaatgagagagtgagactccgtctcaaaaaactaaaaataaaaaaaaacagactctgccaaatgctcactcttagaggctttccttaatcagagtctatgggaagagtccggccttcctgctctgagacagctgctgtctaatgatgcaaacttgtctttcagcacctaggacggctgtgccccatctttggaggaggaaaatcatccctcaggtcatcttctgtgttctgtccacataaggaaagcaaccagcatcaacctgatcgtctagccccattaatgtgtaaatccctgtccacacatggtgaccagtactctgttcccaatcaccattcggtattggagatgcagttaatctacaacctgccagacaggatgctaacctgcaccgaaaccactgtggtctgagtcagctggaggcggcaggagcgctgggcgaccactccagagcctgtctccccagtgacgtcaccttggggagcagcaccagacttgtgtgcagtttctcttccaaaagtgggataatagtacctaccccatagggttgtttgtggattaaatgagataatactttgtgaagatactaggttcagggaatattcagatatcttgttgcaatgaagttggagggagctgaaagatttccagaagatggcagattaagcctgcccggtgagggtcccagtggcagctgtgtcccagccactgtaacccctgacgtggagtcaggggcatgtgaagtgcacacagatgattctgacttctgtgaaccaagtggctgattctgtctaatgtcagttaagccacagctgatggcttgctgtcctggcgtctacccataaagaaatccccaaatgactccaggacacacattaggaccaccattctgtgctgaccaagcatttggaagcagagaaatcaataacccacagctggaatcaacactacaggtcatgttatatacatgttaaaacatacacagctttctgtgatgcattttgagctttctttaggcttttaaaaaaatcttattttgagatataaaaaaattaagggtcagagatttcaggtcaaaaggggctgatcacagctttggtggcaaaagaaagttccataaaggactagataacatacattgcagcgggctcccgacttcagggattacatgctaaaaagtcatcaaagtggctctcttctctggataacattataagcatctcatctacgtgccggtacaatcaggccactcacgataactcagtgacaaagacttcattcagaggttgcttatcagctatttgtgtccccctggcaatttctgtggccttaacagggcagctagactttcccgagtcctgcatttcacccaggaatgaaattcagggagggcccagagtgcagcgtgtgaagcagctagaggcgcgctggaaacctgatgcatgctgctgcctcgctggcgcccaggctcggccggggtggtttcacttctcctcccagcagcctgggttcccgggaggagaagcaaaaccggcagcacccactgagacgccccagctctccaggggcccactccgtagagtgcaaaagaccttagaacagggatgtccaatcttttggcttccctgggccacattggaagaattgtctcaggccacacataaaatacactgacacgacaggtgatgagctaaaaaagaaaaaaaaaaagaaaaagaaatctcataatgtcctaagaaagttgacgaatttgtgtcgaaccacattcaaaggcatcgtgggccccatggagcccgcaggttggacaagctcgccttagaggaaaggtggacacagctctcatctctcagtgagaagcctgaaggcctggagctgctcctcttcctgaggccttccctggtcagcacagactacaacattctctgctgacgcagctggaccctcaaaggctaacgtgagctgcctgtgcaccccacgaggtgtggctctcatccccacctgtgaagctgcctgtgtacccagcgagctgtggctctcaaccctacctgtgaaaaacaagtgcctcttggtggtctcctttctcttctccaaacaggggttcagcagacgcagcagctgcaacacacgctcctctcgccgtgactctgtgaggcaggcgtcgttcatgacgaggtatgggtagatcttgccattgtgtccccggatgtacagccgccgggctgcggtgttgtgcttctgcacaatctctacccggggcatgaacctgccagagcgagaagccatgaggacatgccctgcatctctgctaccagtccttgtcttgagaagaagctaggaatgtccgaactgtcacgggaaaacggactgtgtaggccagcggtcgtttatcaatttatttgtaccctgcctcaccctgatgcggtgtaaatgagtcacaatattttcaattcagcagccacggacggaagtcaaggaggagggagagctggccaggacaggagccagatttggaggaaagggcaactaaactctggacatatagaaaagcagagctgtgtctggttcagaaataaagacgaaacacactttttgttaaaagaaacctcttcaaagccctttcagcatttcaaatgagatgcagcacactctaggaaatgctacaatcatctgattctgcctcaatactgtgcttcgaggatttacaagagtgggacacacactgttttgtcaagttctatggtgactcggaagaaggtctgctgaatgcaaacccagactgcactcaggacagctaaccagtcagcgcgggcagaacttgtaaagtgcctgaccacttacattccagaatcatcttatgttctcccatgtcagggaatctgtgtccaaaattccccacagggtccaccctggagctcccatggggctccatgtccatgggcgccgtgggttagttccacctgccaggctggcccactcaccgtgcaatcttgatgtaataatgcgttggctttggcatcagaaactccccaggaatttccacttcagctgtctgtgccgagaaattgctcaagaaccggcacttttcctctatgaggaagaatttggggagttgcttggtcttggcctccaagattttgatccactttttcaacttagaaataagattatgaagcttcatggatcctggaacgctgaagtcaaaatc

SEQ ID NO: 9152 - DNA, 5541 bp, Homo sapiens
ttttttttttgttgtttttttttgagatggagtctctgccaaaatatttttgtcatcatcagaactcaaaagccacagcacctgagacagaaggagaaattctagagttgaatgacaattctgaagccctcaagcaagagactttccccccgacattacgacactgtatagagcggctttactggccatgtaaaaaaatacctgtaagagggccaacattattgctaaacttaacatacatctttcttacagtatatataacctaaaatttaaatatagattttctcttgatttagttttttgtttttgagacagtcttgctttgtcactcaggatggagtgcagtggcacgatctcggctcactgcaacctctgcctcctgggttcaagcaattctcatgcctcagcctcctgagtagctgggactacaggcgcacgccaccacacttggctaatttttgtatttttagtagagatggggttttgccatgttggccaggctagtctggaactcctggcctcaggtgatctgcccacctcggcctcccaaagtgctgagattacaggcgtgagccaccaagcccggcctcatgttattttttaaagctgttttccgatttgtaggactctgtttcatttatgccaattctcaatgactggcagtagtgcttgtgtcagatgggacaagtactttgcagcgtcccacacaaaggttgtcagagtctcttatgaaactaattttgttatgagccatgtaattaattaatattggtgtttcagtggagtgtggctaccactccagcaggctcaagtcttcctctctgccaggtcttatgtacacacacctgttggtaaggaaaattgtatagtttttagtttggatgtattgggcttcactttatctgacatttctgggtccccatcttcttggaatcctgcttatgacacacgtaccttgtctattgcaaatgttttcttcctaaattttaacttaaaaacgagtctccatagtagattatttcctgtatggtttacaaatacaatcacttgcgtacactttgtcctggaaccatccattgagacgagtagccacatttccttgggggaaccagttctagatgctgctgagatgccccgtgagatgatggaaggttcctgtcttggaacccaaggatgcggggtcagatgctagctgtgacaccctctgacatgtgatttggggcaagtgacttcatattctaacttggttttccacacctgtgaaatggggtaatgcagctggtcctggaccatggtgggtgccaaggtcctgctccaagcatggctgtggcgtccattacgggaacgcaccatgttggctgcacaccctactcacaaggcttttgtcctttagtagtttagtgcttggagttagatggatgtggaaagtatgctctgaagctccagaaaaaagagtgcccgccctggaacccagctctgtagagacagaaaccatccttaattgcttaccctagaaagccagaagtcactgtacatcctctgggtcacaattttgtattttttggtttgctacgatagcttcttaaaggatgtctttttctttgcacaaatactggaaatgagcttccccctggaaatatcgagtcagaagttgaatattcatttcatcttttaaggatctgtcatcttgttagttatgagatctattttgtttttgcagggaattttccagactgccctgttttggtctcagatcaagtcccagaggaacagacagacacgcagtacatcgttagtggtgacgttgcctgacagccagtctaggttacaggggctgccaaagaggcattcccagtacagagaaagaatttctcccaaagacagacaaacagaaaacaagtggagagctttgtcctgatagaagcagtaaatagtaacttggttatgttttggttgtgaaggcccaagacttactttactgtgtgttgattgggcacagtggctcccagcacgttgagagggcaaggcaggaggttcacttgaggccaggagtttgagagcagcctgggcaacctagcgagacactgtctctaccaaaaagcaaaaacaaattacaaatctttgtattagaagcagaaaaacacaggggacatggagaactcatcaccaaccctgccccaccccccattcctctcccctcccacatatacttctcactgcctgtccttggccttgaggttggtcctagggctggactgcccacacggtgactctcttttgtcctttttcagctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtggttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccaatttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggggaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatttgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgactttacattt

SEQ ID NO: 9153 - DNA, 2281 bp, Homo sapiens; identical to SEQ ID NO: 9128

SEQ ID NO: 9154 - DNA, 2715 bp, Homo sapiens
tagacctcctgcaaaggaaatggtcacactcttggttgaccttagcttagtgggtaagcccaatgagcaaagagaacaaaaacctgaggagtgttggaaaaggggaaactcatcttccaaagtattttgcttctatgagaaagggaatccattacataacattcttggtttctctctgctccctctttcacttctaccagacagaaggagtgaattttctgactagaaatttaaaggacaggaactagcatctgtgctttggtcccttcctcctttttttctttgggatttgcctgtctgcagagagaacacagcctgttctgctccaccattgtataaacatcagagtggaagggtctgccccatgcagttggatgactggagttgtccaacactgtctgactatgtatataaataagtgcctaatttgggggctcagtattaagaagcttgcttgcccacagcagtaagccatgttctgcaatatcttaattagcagtaaaggtgatatttcatctccatctgcttggccatttatcagctggctcttctagaaggtacacagcctcttagcaaatggtggatgtggccaggattaccatgaaaccaccttttggaaagttaccactaaatacactaagtccagtcagtcaggaggcagagtagacttgtttcacatagaactaaggctggacaaaataaagccagagagctgatagcttggatatcattgtgagctagttagacatagactttctgaaaaaccatcagtactagggtcttaacttgttgagtcccacaaacagccttgagaaagaattttagtgcttagtgcaggtcatttttttaagaggtaaacccggaatataccggttcaggaagtaggagagtgaaaaatgcaaaaacaaaaaacaaaaaccatgaaactgtatattaaggaagaagttgctggtatgggaactaggactcaacctcactgaggacctctgggagattgcacagaacactattcttacagttgccccacaacaccccccgccgccccctcactaccaccaccaaggggcaaaaaagctaggccattcacccactcccattggtcatgggttgagggctgttcccaggggcagtattaattccctggcacttccagcttgcctcacacattgatttagcatcctctgaaggtaggggaaggccctcacacaaagactgagaaactgttattgcaaaaaagaactggcagatcatgacagtaactgctacaaatctaggtgttgtgtcaccacagaagaaaacattttatgtaaggctcagtggtcctcacagcttttctatctcacttgacaatgaagatacaatcttacaaggtgtctagccaggaattttatcttcatcaagggtaaagagacgatgggaaacaggatcagagagatgaggacctgccaaaagaaaaaagcacaacaaagtgacatccaacaatataatatatgggaatttaaaatgagacaaagccaagtcctgagcttttttaatgaatggaggaaaagcaattctttgagaggatggagtagaacatgcactcagaacaagaataaatgttttaatgtcagtactttgctgaatgtatatgcagaattgacagactccatccatttccatcaagggcatcaaatttcaactattgtttgcttagtctgcaaaaatagccaccctgcatccttgaagcttaattcaactccttcagtaagttttagatgatgggtagttaaaggattaaactgctgcagttgaactcttatgccttataattgatatattgaaaggctaaagcatgttcgattcctgatgatagcaatctgcagtggcatcataagcacattaaattcagactgaaacattcagcgaagttaatattgacttcacaatgttctaagatgtaagtgaagctatgctctttttgccttataaaattagactgcaaaaaaacaatttttgaggatattcccagtcaattgacttggttacagagtgagcaggaaatcaaactctagttaagttcatagatactggtgttttattcatttggaaacagaagagaaaaagagtatgctgtagtaaattgtttataaattctttttaattctaaaggagggggagaaagtgaaagtaaaaagcaaacattattaatctcttactgtcacaaaaaaaacaacccactcttacacctccatcattgcctaaaagacaaaaactccaaagactggcatttgagactcctcacagtctgccaaaactgcctcctccctcgtcaggtcagtcaccaagtcctttcagttctatctccaaacacatctcagtccctgccaccatggtctgttatctgaactactataacagtttcctaactggcctccctccttcctctctggaccctccagtgtgttccttcgtaacagctagagtggatttttaaaagtcctcccatggagttggagaccagcctggccaacatggtgaaaccccgtctctaccaaaaataataaaattagctgggcatggtggtgcacacttgtaatcccagctacttgagaggcagaggtgggaggatcacttgaaccccggaggtggaggctgcagtgaattgagattgtgccactgcactccagcctgggtgacagagtgagactccatctcaaaaaaaaaaaaaaaaat

SEQ ID NO: 9155 - DNA, 273 bp, Homo sapiens
gagccagactgcactttgctgtgtgggatctagaaggtggcgtgctggaagctggtgctgagtgatacatggggacaaggtgggagtgagagagaccagcaaggcagtgaagagactggagagagactgaaggggtcagagaaagggcagagcattcagcatgggagaggcgaagaagactttgaggatattttgttgaacaaggcatggtgtgcaggtgacttccttaaaaacattcctctggaagcagaaaatagatgattaccaggggct

SEQ ID NO: 9156 - DNA, 445 bp, Homo sapiens
atgttttccagctgaaataagtgaaggaatgaaggggaaactattcttagaagctagccttcacaagccgaggcaattccaaagcccaaggcaacaacaggagccactgtggcaaagaactgggaagtgagcacacaggagagtgtggaaactatgccatcattatttagagcacaaactccctggatcaggggatgttgaagagagagggctcaaaaggaaaatacagaatggggaaaaaaagggtcaaaacagaccgcgcaactgggcttgccatcattgcctatttctcaacttggcaagaatgcaaatgtctcatatgtcaccctgagagaaatatctgtggattcttcctcgaggaatgataaaacatgttaacgtcttcaggaggattccccccaatcaggtttaagttcagagatcaaggagatcaggtaacacacag

SEQ ID NO: 9157 - DNA, 4753 bp, Homo sapiens
tgttacagactttggtaatttattaatacacttgtaaaatcttaatagcataagaataaaaattattagtgatcatgtaaatacatgaaacatttaaaaaataatccaaccaaatatgttacaactttgtttttatccaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagattattgattagtgatcatcaacattttcccgcattcatgcagtgcggcctctgaaaacatggttgaacatcctatggaatttttttttttttttgagatggagtctcactctgtcacctaggctagagtgcaatggcgcgatcttggcttactgcaacctccgcctgccccacctcgggttcaagtgattctcctgcctcagcctcctgagtacctgggactacaggcatgcaccaccacgcccggctaatttttgtatttttagacgagacagggtttcaccctgttggccaggctggtctcaaactcctaacctcaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaaggcatttggtaaaccacacagcctctgcatccttcctagcgacagccacaagaaaaggtgggcatgggagggaaaatgctcttgtgaattgaactggaggcaagctccacttttctttagaaaaagatgtagatcaaaataactaatattttcttccttgctcgatttctgtgccttccatggtacatcaaaataataggaccagtaatggccacaatcctgttgactgctgttaccttcgccccaatatttctttaagcatttcttaagcatctagcttgtgttttgttatatttaacagattttcttaaagtattgtatgaattaaaaccagaaataacttcattttcctagaaagggataatttctcccggagaataaatcctgaggatttagttagatgctgtgggtattgtattttaaataatattttaatgggagcagctgattgactttcaaatggattgtttacattaatagtaattctgcagttgttttactattgcatcagtctgccagacaagttccatgtgcatattttaattcagaactaattatacttaaaaatttaaaccctgcatacttccccaaaaatgtttagggcagttaaaaacaactcttttggaagatgactcgcattttaagaaatgagagaacactgtcaaatgatgaatgcatttaaaaaataatttgcaaagtgataaaagcccttagttttaaatcttacaatgacattagctcttacaagaactcagtaagtatttgctgttttttaatgggatagtaataaggttgaggtttttgttaagggacgtttacttatcatcaaactctatacttactactacaaggaaactccaagtacattaaacactatgttttataattctttgccacactgccaataaattctgttcacattttaaggatgacaagtccactatatgtaacacgtaagaatgctatcctggcagtagacacagggccagaataaactggcaagttttcattccacacaagtgtgggaaaaaaatgactacaacttaaactttatttacttgattgagagcttattgcacatgaaatgttttatgtggttgatcttaacttcgtttacattgacttctatgctcaagattgttcaattgctgctgctgccgttgtgttttctttcaggatcgaggtgggtaccttcatataatatcttctttttaatttcttctctggcaattctttcctggattctttgctttgcataattatacctacaatgaaaccttagaagaaaagaatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattcccctagtaattacctttcatattttattaactaggttaacatcaactgtggttgtaagagtaaatgtttcaccttaagataaacatgggcaatatattaaactctagtctgttttcttgcctgtgaagtgaggctgcacttgattatatttgattctttgttcgtaatacatgggaacgacagctaagtgtggtgaaaaacgcggggatccaaagagctggatttttatctcagatctgccgctaacttttgtatcctataggctacttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtat

SEQ ID NO: 9158 - DNA, 13422 bp, Homo sapiens; identical to SEQ ID NO: 7508

SEQ ID NO: 9159 - DNA, 102 bp, Homo sapiens; identical to SEQ ID NO: 7509

SEQ ID NO: 9160 - DNA, 640 bp, Homo sapiens; identical to SEQ ID NO: 8187

SEQ ID NO: 9161 - DNA, 606 bp, Homo sapiens; identical to SEQ ID NO: 8188

SEQ ID NO: 9162 - DNA, 628 bp, Homo sapiens; identical to SEQ ID NO: 8189

SEQ ID NO: 9163 - DNA, 640 bp, Homo sapiens; identical to SEQ ID NO: 8187

SEQ ID NO: 9164 - DNA, 513 bp, Homo sapiens; identical to SEQ ID NO: 8191

SEQ ID NO: 9165 - DNA, 612 bp, Homo sapiens; identical to SEQ ID NO: 8192

SEQ ID NO: 9166 - DNA, 640 bp, Homo sapiens; identical to SEQ ID NO: 8187

SEQ ID NO: 9167 - DNA, 640 bp, Homo sapiens; identical to SEQ ID NO: 8187

SEQ ID NO: 9168 - DNA, 654 bp, Homo sapiens; identical to SEQ ID NO: 8195

SEQ ID NO: 9169 - DNA, 647 bp, Homo sapiens; identical to SEQ ID NO: 8196
  misc_feature (29)..(29): n equals a,t,g, or c

SEQ ID NO: 9170 - DNA, 640 bp, Homo sapiens; identical to SEQ ID NO: 8197

SEQ ID NO: 9171 - DNA, 640 bp, Homo sapiens; identical to SEQ ID NO: 8198

SEQ ID NO: 9172 - DNA, 571 bp, Homo sapiens; identical to SEQ ID NO: 8199

SEQ ID NO: 9173 - DNA, 640 bp, Homo sapiens; identical to SEQ ID NO: 8187

SEQ ID NO: 9174 - DNA, 639 bp, Homo sapiens; identical to SEQ ID NO: 8201
  misc_feature (88)..(88): n equals a,t,g, or c

SEQ ID NO: 9175 - DNA, 648 bp, Homo sapiens; identical to SEQ ID NO: 8202

SEQ ID NO: 9176 - DNA, 624 bp, Homo sapiens; identical to SEQ ID NO: 8203

SEQ ID NO: 9177 - DNA, 509 bp, Homo sapiens; identical to SEQ ID NO: 8204

SEQ ID NO: 9178 - DNA, 654 bp, Homo sapiens; identical to SEQ ID NO: 8205

SEQ ID NO: 9179 - DNA, 546 bp, Homo sapiens; identical to SEQ ID NO: 8206
  misc_feature (20)..(20): n equals a,t,g, or c

SEQ ID NO: 9180 - DNA, 654 bp, Homo sapiens; identical to SEQ ID NO: 8195

SEQ ID NO: 9181 - DNA, 5505 bp, Homo sapiens
ttttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatagtgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagt

SEQ ID NO: 9182 - DNA, 8573 bp, Homo sapiens
ttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttatgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagt

SEQ ID NO: 9183 - DNA, 8224 bp, Homo sapiens
ttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttga

SEQ ID NO: 9184 - DNA, 3034 bp, Homo sapiens
ccgggcgcggtggctcacgcctgtaatcccagcactttgggaggccgaagtgggcggatcacgaggtcaggggatcgagaccatcctggctaacatggtgaaaccccgtctctactaaaaatacaaaaaaaattagccaggcctggtagcgggcacctgtagtcacagctacttgggaggctgagacaggagaatggcatgaacccgggaggcagagcttgcagtgagccgagattgcaccactgcactccagcctgggcgacagagcgagactccgtctcaaaaaaaaaaaaaaaaaaaaccctaagacccaggcaacattagaaaaatgtacacaatgccaggtatggtggtggctcatgcctataatcccagcacttcgggaggccaaggcaggcagatcacttgaggtcaggagttttgagaccagcctggccaacacggcgaaaccctgtctctactaaaaaataaaaattagccaggcatggtggcatacgcctgtaatcccaggtactcaggaacatgaggcagaaaaattgcttgaacccaggaggcggaggttgctgtgagccaagatcgcacctctgcagtccagcctgggtgacagagtgaggctgtgtctctcaaaaaaaaaaaaaaaaaaaaaaaaagtgtacacaaaccctagagcccccacacaataagaatgtgttgccttatgactgaaattgatacttcttaactagggcagaggaaaatattctgtagtgaataggaacaaacacctttatttcatgatctgtctacacagaaagatgataataaaattcagcaaaggaaatgtagctgtaatgttatgacctaggaattggctattggagaaacacatctataaaatgagtgtgaaattctgtcgtcccttagaagtatatagatgcttaagaaataggtatcttctcaaaagaaacaaatgagatattaatgattttgcctaatttgatgggggtgggggaagtacacagattggtatgtcagagttgctcttcaaataaggagatctagaatctagtttcagtcacttcctttttgcccctgtgggcatgtaggtcttctagcaactcaaggccacatgcttagacaacacagattagttttgtacatgtgtttaaatcactgtggtgatatgtgtcacaacaacagctaaaatcagataactttattccatctacagtggcttatttatgtcaggaaaatagggggcaattattttccatcaaagaggtgaaaagcaaattaagaaatgttttaagacccactaaggtttttttttttttttttttttggggacacattaagcaaagccaccatggtaccttaggctactaatgcatttgattcttcttaaccccaacctgttgttttaggtgattgaacctgtgattcagccttcagtaggtgttagaggcatccaacacaggtggcaagtatcgtctacagcacctctacttcacagttacattcagctgctgtgattcctggccgaccctattattcatacttcagggtttgtgtgtttatatagaaaaggaaatgtggctctcaacccgagatcgcgctgctgcacttcaacctgggtgacagagtgagactcagtctcaaaaaaaaaaaaaattgctttataatttaaaagattctttgctttgctttctcttttaacttactgctgcctgggaggaggtgagcatttacgtctccattctacagatgaggaagatgaggctttaaaaggttagtagctgtcccagggactcaaagctagtaagtgacagcattacaagtggcacctaagccttctggtttcaaatccccttactgtgccatatggtacagtttcccactgcgttgtacatgttgtggaataagaataaggctcacagctgttactagttaataacgtattcaccattggtagaaaactcagaacttgtggttaaagtggattttgttctcttgcccaagactgttaaccatcatcaacacaacagctaaaatcagcctgttacgctcacctgctgtttaatatctagattcataaagatgagagaatggaaaaactgcaaaagtggtgaaaacaaattctgataataggttaatcagaattatctaggaaacagttattagatgaaaggggctaggtaggtcacaaaggtaagttctcttccatcaaggaactcttgaagtggatgccattagacctttacaaacaacggatataccgtgtgctgtattagaggtatggaaccgaaagtaaaggacagatgcgcccttgtcttgtcaacagtaagagcctcttgtccatcaagagaattcatgtactttatagggtactaactctactaaaactaactctataaagaacttaagactgctcttcctggggaacttgtctacaggcactcagaatggtccagcatttgacatactgtcataggctttcctacaatacagcctctaacaaaactacgcgaacccctggtaatagaattgtttacctttataccaagaaggttgggaaagcatcaaaatctgcgtgtggcgtgtgcccaggcagactttgaagggtttgtgctgtaagacctaaagttcttatgaggttgtccaaaacaaagaaacatgtcagcagggcctatgttggttccatgtgtgctaaatgtgtttgtgacaggatcaagcgtgctttccttatcaaggagcagaaaattgttgtgaaagtgttgaaggcacaagcagagtcagaaagctaaataaaaaatgaagcttttttgagtaataaaaatgaaaagacttgctgtatggaaaaaaaaaaagactatcttacgttgtcagccaacaggataccacattaattctttaaatactgaattttgccgggcgcggtggctcacgcctgtaatcccagcactttgggaggctgaggcgggcagatcacgaggtcaggagatcgagaccatcctggttaacacggtgaaaccccgtctctactaaaaatacaaaa

SEQ ID NO: 9185 - DNA, 3032 bp, Homo sapiens
ccgggcgcggtggctcacgcctgtaatcccagcactttgggaggccgaagtgggcggatcacgaggtcaggggatcgagaccatcctggctaacatggtgaaaccccgtctctactaaaaatacaaaaaaaattagccaggcctggtagcgggcacctgtagtcacagctacttgggaggctgagacaggagaatggcatgaacccgggaggcagagcttgcagtgagccgagattgcaccactgcactccagcctgggcgacagagcgagactccgtctcaaaaaaaaaaaaaaaaaaaaccctaagacccaggcaacattagaaaaatgtacccaatgccaggtatggtggtggctcatgcctataatcccagcacttcgggaggccaaggcaggcagatcacttgaggtcaggagttttgagaccagcctggccaacacggcgaaaccctgtctctactaaaaaataaaaattagccaggcatggtggcatacgcctgtaatcccaggtactcaggaacatgaggcagaaaaattgcttgaacccaggaggcggaggttgctgtgagccaagatcgcacctctgcagtccagcctgggtgacagagtgaggctgtgtctcaaaaaaaaaaaaaaaaaaaaaaaaagtgtacacaaaccctagagcccccacacaataagaatgtgttgccttatgactgaaattgatacttcttaactagggcagaggaaaatattctgtagtgaataggaacaaacacctttatttcatgatctgtctacacagaaagatgataataaaattcagcaaaggaaatgtagctgtaatgttatgacctaggaattggctattggagaaacacatctataaaatgagtgtgaaattctgtcgtcccttagaagtatatagatgcttaagaaataggtatcttctcaaaagaaacaaatgagatattaatgattttgcctaatttgatgggggtgggggaagtacacagattggtatgtcagagttgctcttcaaataaggagatctagaatctagtttcagtcacttcctttttgcccctgtgggcatgtaggtcttctagcaactcaaggccacatgcttagacaacacagattagttttgtacatgtgtttaaatcactgtggtgatatgtgtcacaacaacagctaaaatcagataactttattccatctacagtggcttatttatgtcaggaaaatagggggcaattattttccatcaaagaggtgaaaagcaaattaagaaatgttttaagacccactaaggtttttttttttttttttttttggggacacattaagcaaagccaccatggtaccttaggctactaatgcatttgattcttcttaaccccaacctgttgttttaggtgattgaacctgtgattcagccttcagtaggtgttagaggcatccaacacaggtggcaagtatcgtctacagcacctctacttcacagttacattcagctgctgtgattcctggccgaccctattattcatacttcagggtttgtgtgtttatatagaaaaggaaatgtggctctcaacccgagatcgcgctgctgcacttcaacctgggtgacagagtgagactcagtctcaaaaaaaaaaaaaattgctttataatttaaaagattctttgctttgctttctcttttaacttactgctgcctgggaggaggtgagcatttacgtctccattctacagatgaggaagatgaggctttaaaaggttagtagctgtcccagggactcaaagctagtaagtgacagcattacaagtggcacctaagccttctggtttcaaatccccttactgtgccatatggtacagtttcccactgcgttgtacatgttgtggaataagaataaggctcacagctgttactagttaataacgtattcaccattggtagaaaactcagaacttgtggttaaagtggattttgttctcttgcccaagactgttaaccatcatcaacacaacagctaaaatcagcctgttacgctcacctgctgtttaatatctagattcataaagatgagagaatggaaaaactgcaaaagtggtgaaaacaaattctgataataggttaatcagaattatctaggaaacagttattagatgaaaggggctaggtaggtcacaaaggtaagttctcttccatcaaggaactcttgaagtggatgccattagacctttacaaacaacggatataccgtgtgctgtattagaggtatggaaccgaaagtaaaggacagatgcgcccttgtcttgtcaacagtaagagcctcttgtccatcaagagaattcatgtactttatagggtactaactctactaaaactaactctataaagaacttaagactgctcttcctggggaacttgtctacaggcactcagaatggtccagcatttgacatactgtcataggctttcctacaatacagcctctaacaaaactacgcgaacccctggtaatagaattgtttacctttataccaagaaggttgggaaagcatcaaaatctgcgtgtggcgtgtgcccaggcagactttgaagggtttgtgctgtaagacctaaagttcttatgaggttgtccaaaacaaagaaacatgtcagcagggcctatgttggttccatgtgtgctaaatgtgtttgtgacaggatcaagcgtgctttccttatcaaggagcagaaaattgttgtgaaagtgttgaaggcacaagcagagtcagaaagctaaataaaaaatgaagcttttttgagtaataaaaatgaaaagacttgctgtatggaaaaaaaaaaagactatcttacgttgtcagccaacaggataccacattaattctttaaatactgaattttgccgggcgcggtggctcacgcctgtaatcccagcactttgggaggctgaggcgggcagatcacgaggtcaggagatcgagaccatcctggttaacacggtgaaaccccgtctctactaaaaatacaaaa

SEQ ID NO: 9186 - DNA, 3032 bp, Homo sapiens
ccgggcgcggtggctcacgcctgtaatcccagcactttgggaggccgaagtgggcggatcacgaggtcaggggatcgagaccatcctggctaacatggtgaaaccccgtctctactaaaaatacaaaaaaaattagccaggcctggtagcgggcacctgtagtcacagctacttgggaggctgagacaggagaatggcatgaacccgggaggcagagcttgcagtgagccgagattgcaccactgcactccagcctgggcgacagagcgagactccgtctcaaaaaaaaaaaaaaaaaaaaccctaagacccaggcaacattagaaaaatgtacacaatgccaggtatggtggtggctcatgcctataatcccagcacttcgggaggccaaggcaggcagatcacttgaggtcaggagttttgagaccagcctggccaacacggcgaaaccctgtctctactaaaaaataaaaattagccaggcatggtggcatacgcctgtaatcccaggtactcaggaacatgaggcagaaaaattgcttgaacccaggaggcggaggttgctgtgagccaagatcgcacctctgcagtccagcctgggtgacagagtgaggctgtgtctcaaaaaaaaaaaaaaaaaaaaaaaaagtgtacacaaaccctagagcccccacacaataagaatgtgttgccttatgactgaaattgatacttcttaactagggcagaggaaaatattctgtagtgaataggaacaaacacctttatttcatgatctgtctacacagaaagatgataataaaattcagcaaaggaaatgtagctgtaatgttatgacctaggaattggctattggagaaacacatctataaaatgagtgtgaaattctgtcgtcccttagaagtatatagatgcttaagaaataggtatcttctcaaaagaaacaaatgagatattaatgattttgcctaatttgatgggggtgggggaagtacacagattggtatgtcagagttgctcttcaaataaggagatctagaatctagtttcagtcacttcctttttgcccctgtgggcatgtaggtcttctagcaactcaaggccacatgcttagacaacacagattagttttgtacatgtgtttaaatcactgtggtgatatgtgtcacaacaacagctaaaatcagataactttattccatctacagtggcttatttatgtcaggaaaatagggggcaattattttccatcaaagaggtgaaaagcaaattaagaaatgttttaagacccactaaggtttttttttttttttttttttggggacacattaagcaaagccaccatggtaccttaggctactaatgcatttgattcttcttaaccccaacctgttgttttaggtgattgaacctgtgattcagccttcagtaggtgttagaggcatccaacacaggtggcaagtatcgtctacagcacctctacttcacagttacattcagctgctgtgattcctggccgaccctattattcatacttcagggtttgtgtgtttatatagaaaaggaaatgtggctctcaacccgagatcgcgctgctgcacttcaacctgggtgacagagtgagactcagtctcaaaaaaaaaaaaaattgctttataatttaaaagattctttgctttgctttctcttttaacttactgctgcctgggaggaggtgagcatttacgtctccattctacagatgaggaagatgaggctttaaaaggttagtagctgtcccagggactcaaagctagtaagtgacagcattacaagtggcacctaagccttctggtttcaaatccccttactgtgccatatggtacagtttcccactgcgttgtacatgttgtggaataagaataaggctcacagctgttactagttaataacgtattcaccattggtagaaaactcagaacttgtggttaaagtggattttgttctcttgcccaagactgttaaccatcatcaacacaacagctaaaatcagcctgttacgctcacctgctgtttaatatctagattcataaagatgagagaatggaaaaactgcaaaagtggtgaaaacaaattctgataataggttaatcagaattatctaggaaacagttattagatgaaaggggctaggtaggtcacaaaggtaagttctcttccatcaaggaactcttgaagtggatgccattagacctttacaaacaacggatataccgtgtgctgtattagaggtatggaaccgaaagtaaaggacagatgcgcccttgtcttgtcaacagtaagagcctcttgtccatcaagagaattcatgtactttatagggtactaactctactaaaactaactctataaagaacttaagactgctcttcctggggaacttgtctacaggcactcagaatggtccagcatttgacatactgtcataggctttcctacaatacagcctctaacaaaactacgcgaacccctggtaatagaattgtttacctttataccaagaaggttgggaaagcatcaaaatctgcgtgtggcgtgtgcccaggcagactttgaagggtttgtgctgtaagacctaaagttcttatgaggttgtccaaaacaaagaaacatgtcagcagggcctatgttggttccatgtgtgctaaatgtgtttgtgacaggatcaagcgtgctttccttatcaaggagcagaaaattgttgtgaaagtgttgaaggcacaagcagagtcagaaagctaaataaaaaatgaagcttttttgagtaataaaaatgaaaagacttgctgtatggaaaaaaaaaaagactatcttacgttgtcagccaacaggataccacattaattctttaaatactgaattttgccgggcgcggtggctcacgcctgtaatcccagcactttgggaggctgaggcgggcagatcacgaggtcaggagatcgagaccatcctggttaacacggtgaaaccccgtctctactaaaaatacaaaa

SEQ ID NO: 9187 - DNA, 1672 bp, Homo sapiens
cttttctccctccctccttcccctctctcccttccctccctccttcccctctctcccttccctccctcccttcccttctcccctctctcccctccctctctccctccatcatggggctgtcagctgcatcgcaaatctgtgggctctgcctcctctggctctctcctcattttgcctcacagatatgtcccccagtacacatcttgcccacatctaatcctggctcagtgtctgcgtctcagaggacgtggaccaaggcacttgccgtctcaggcttagttgacccttcaacctcctgagaactctgggcccaggcaaccctagagaactgactcctgtccatgttctcctttctctggaaaccacttagctgcctccgtcatgctctgggcaaaggcagggcaggttgggagaaggaatcagtgaggctgaggccccagcctaaaggtcacagggccgcctggcccaggagaaatcccctgcaccaggcatttgcccacatggctacaagtgaacgttgggatacggagtgttcttttttgctatgaaactggagtcatggaggtcctggtcgacattcttccttccaaatacagtggcctggatgggggagggcagtggctatagaggcttcctgcaccgtgtcggggctcttgtccattgcaagctgggaccccaagctacccacgtggtgtttggctcccgtctgatagggaaagactttgaagtccacatccaggcataatggatagccaggctgcctaagtggtttgatagatctcccagaaaattcccagatggactctggacgcacagccatgccacagctttcctcctcttgggaacagactaccagtgagaggctttactctgaagccaggtgcaccagggcccctgtgtcttttcctctaaaatctctgcaggtctgcactaagagaaaaatagaaagttcaacttgctaagagccccttttgcttaggaaacttcttttcatggtttttcacttcataaatggacttgattggaatgaacctttaggcaaatgacactgtcaatgggcatcacggccacactctgccttggaaagagtaacacagaggagggttacgcacttacgtcagaagagtagctctgttgagtctatagagatttggccccaggataagggtagcaccttctcttgtccactgtctatgatcaaggtggccagaccaaccctgggggctagaacatggtagaccctactggtgacatctgaaaatggtttggctttacgtagatgaaggaaaagtatgtgcaaagaccttgcccattctgtctcactttttaagagtcaatatgcaatctggaggcaaagatagacaaaccaactgatgtggtttggctgtgtccccacccaaatctcatcttgaattgtagctcccataattccgtgatgtgggagggacctggtgggagataattgaatcatgggggcagtttccccccatactgttcttgtggtagtgaataagtctcaagaggtctgatggtttagaaggggaaaccattttcacttggttctcattctctctcttgcctgccatcatgaagacgtgccttctgccatgattgtgaagttctagccacgtggaactgtgagtccattaaacctctttttctttataaatta

SEQ ID NO: 9188 - DNA, 30704 bp, Homo sapiens
cagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcaggtaccctgcctccattttggttaccatccccacttattatgggctgtgggctgttatggtgatggatggatgtggatttggaaggggaccatgagagatgatgtattatgatgaactcatgatttaattctttggtgaaaatagcaccctctgacctgtacttgagaccgcaggatgaagccagcacggttttttgtactcccccagggtgagtgcactctcccaggaccctcctggccaaccaggggtcacgttctgcaccacattccttctgaggccctggccagggcggtgctgatcttgctgttgccacagaagcctctcctgcccctgccatccgcccatcacatgttctccaacgcaaatctgcctggccttatgggcggcgttccctggctcttaggagaaaaagccagatctttaccatggaccatgaggctcagagaggtctaggctgagcccacccctgcggcctagcagatgcccttccccttcactctgcacctggtccctgtcttctctcatggcctcacatgggccacacccctgccccccactgggcctttgctcatgatgtgcattctttctggaagacccctgcccccctccccagccctctgcccagtggctcctagccactcctcacatggagtcaggactcacatctccagagatccccctctgcccccaaccctgaacaacatcagggccccccttagattctaggtcctgtgttctttgctgctgggactggggtgaggtcggtgggggagcatataaataaccttcctttatttcttgtccaagttcatcactatacacagaggtgtacagtgagacccacataaacaatcccactaaacccaactcaactggcccttacccagatcctccaaatgtcccaggcctccctagtgtcacctgatatgcagtggcatcagcaggaaagggaacagtggtcttaaggattgcagctaaaagatctgactgtggcattgtaaactgtaaggaatgtgtcagtgaacccgtggctaagcccactcccgggtctcggtggggtctgtgcacaggtggcagaagtgtgagctccatgagctttacagtgaatcagctgtggggcacagagggcaagcttttcctccaccctacgaaggctccttgagaaacaattgaccaaaggcagaccaataggaaaaagaaaagcattccaacgtaacgtgcatggcatggggaattgcaggagagtgatgaccccacaaaccagtgaggtccaggtgcttccacaccctcatagggagacgggaaatgggggaaatgtggccgtttagagggtaaagcgtgatttatagggggaacgaatcgatccagaggcaggcactgtcttgggagtgatccttcccagactggccaatcaggtatttctcctcctccccagagaagaataaaagagagagggagaggggccagggaagtcccttgtgctgtcccccagagagtggaagcccctccctctatggaaaccagaggagtgggagatgggattattctcccctaaatgtttcctctatagcccttaacagagtgtgcagttcggtgctttgagtaatcatttgattcgcacctgacgtcccccctggaatgtacaccattgaccggccacatgccacctggcatataacaggcattcatggtcacctggtggaaggaagggagggaggcctgggaatattcctttcctcctgtggcaactggtttggaaggaagggagggaggaacgctgagtatatactttcctcctgtggtgtatggattggaaaggaaggagggagggagggaggccaggaatactattttccccccatggcttatagatttggctgtgtgtcagcattacccaggggctcattaaaaacaacattcttagccccatcccagagattctgagtcagcagattggacaggaggcctggggatctgttttttccccactgggctcccgctgatggacttggtccacttcctgatgcacctcctgcccaccgacatagcctgcagtccagccgctggacttagtctgaggtgagctcttcatccgccttgttctggctgtggtggccatgaacatgtacctcttgggtccccaacggcaaggagcaaaaacgaccaacatccttgggatttcctgccgtgctcagaaatccttccctgcgtgagcatggaggccacacttcctgcagggtgctcccagtgcctgcaagaggcagggatgtggaggcctccttagcccacatgacagggctcctccagaggacagcctgggccccaggacttcttgctctacctgctgagatgtagaactgtgcagcaccagagtcttgcctccctccctcctttctaccctctcttcactcccttcctcccctccctcccttctttccttaccccctctgtccttcttttctccctccctccttcccctctctcccttccctccctccttcccctctctcccttccctccctcccttcccttctcccctctctcccctccctctctccctccatcatggggctgtcagctgcatcgcaaatctgtgggctctgcctcctctggctctctcctcattttgcctcacagatatgtcccccagtacacatcttgcccacatctaatcctggctcagtgtctgcgtctcagaggacgtggaccaaggcacttgccgtctcaggcttagttgacccttcaacctcctgagaactctgggcccaggcaaccctagagaactgactcctgtccatgttctcctttctctggaaaccacttagctgcctccgtcatgctctgggcaaaggcagggcaggttgggagaaggaatcagtgaggctgaggccccagcctaaaggtcacagggccgcctggcccaggagaaatcccctgcaccaggcatttgcccacatggctacaagtgaacgttgggatacggagtgttcttttttgctatgaaactggagtcatggaggtcctggtcgacattcttccttccaaatacagtggcctggatgggggagggcagtggctatagaggcttcctgcaccgtgtcggggctcttgtccattgcaagctgggaccccaagctacccacgtggtgtttggctcccgtctgatagggaaagactttgaagtccacatccaggcataatggatagccaggctgcctaagtggtttgatagatctcccagaaaattcccagatggactctggacgcacagccatgccacagctttcctcctcttgggaacagactaccagtgagaggctttactctgaagccaggtgcaccagggcccctgtgtcttttcctctaaaatctctgcaggtctgcactaagagaaaaatagaaagttcaacttgctaagagccccttttgcttaggaaacttcttttcatggtttttcacttcataaatggacttgattggaatgaacctttaggcaaatgacactgtcaatgggcatcacggccacactctgccttggaaagagtaacacagaggagggttacgcacttacgtcagaagagtagctctgttgagtctatagagatttggccccaggataagggtagcaccttctcttgtccactgtctatgatcaaggtggccagaccaaccctgggggctagaacatggtagaccctactggtgacatctgaaaatggtttggctttacgtagatgaaggaaaagtatgtgcaaagaccttgcccattctgtctcactttttaagagtcaatatgcaatctggaggcaaagatagacaaaccaactgatgtggtttggctgtgtccccacccaaatctcatcttgaattgtagctcccataattccgtgatgtgggagggacctggtgggagataattgaatcatgggggcagtttccccccatactgttcttgtggtagtgaataagtctcaagaggtctgatggtttagaaggggaaaccattttcacttggttctcattctctctcttgcctgccatcatgaagacgtgccttctgccatgattgtgaagttctagccacgtggaactgtgagtccattaaacctctttttctttataaattacccagtcttgggtatgtctttatcagcagagtgagaacagactaatacaccaacaaatgcagaggggccagaaccaccccttcctgggacatcagagccaacagttaagtggtctggattccaaactcatttacttaatgtcgataggttgaaattggccatggcaagagacttatgttgaaacttaatacccaatgtggcagtactgaaaggtggggcctgttagaggtgattgggtcatgagggctctcccttcatgaatggattaattcattcatagattaatgtatcagtgagtcagtggattaatgggttatcatgggagcgggaccagcagctttataagcagaggaagcgagacctgagccaatacactcagccccctcaccatgtgatgccctgcactgccttaggactctgcagagtccccaccagcaagaaggctctcaccaaatgcaccagcaccaccccaaccttggacttctcagtctcaaagtctgtaagaaatgaattccttttctttataaattaccccatctcaggtattcagttacagtgatgccaaatggactaagacagaaaatcggtaacagaagtggggtccacagaactagcaaacactacaaacaagggctttctaccccacccaccttcacccattgttcaacattgatttggcagcacacttctggaccactgaatcagaagggtcaatcacctgacttacaacaaaggccccactgcatcttaatgggggaaagaatagtctttgcaataaatggtgttgggtcaatgggagatcatatgggaaatggagaaccttcagtcctaccttatattgtacataaagattattgagagatggctcagagacctaaatgtgaaagataaaacttctagaaaaaacccagaagactactgtggtaggcagaataacgctccccgtccctgccaacaagatgaccacatcctaatccctgggcctgtgagtatgttatgtcacatggctgggagaattgggttgcagatgaatgaatgagaatagccttcccctaaaactttctgagaaactctctctccctcctcccaaaatctcaagaggtaaaaggaagtcacatgccttaaaaggagtgttgcagctcagtctccaagaactaaggattatctgagctaccaggtctcctgtcccctttaactgtgcctcttggaggcgctggggaacccaaagttcgacatgggctctagattatgctggttggacagtggctcccatgacctgggagtcaggcaagcaccccgtcagagtctgtcttagagaaggtgctagggctgcttctgcttccacttccaccctgacaggactgaggaggccaggcccagagaacaggctggataacttcatcctgccaactttacttttctggaagtttccctttaatagtccaaatgggccaaagccgaacatcaaaaatccttaccatccgttcttggtctttccatccaaaaatccttaccatccattcttggtctttctcagtagttagttaaccttgtttcaaggaagtctataactgaccctgagccaacacttctttcaaccttgacaaaggtatccacacgaagccgaggagcgggggaggagaagggtacatgaaaagccctgcgttgatgtgggaccagagcatccaaagccatctgcctcaaatgcccttggagctcagtaattaggagcaaggagctttggactagggcccaaagtgcctgggtcctggattcaaatcctggttccatcacttcctaagtgtgtgatcctaaacaagttattgatctcactctgagtcagtttcctcatctgtacaatggggataataatccctacctcatagagcacctggcatatagcaactgctatacagctatcagcccatgtatttgttgtcattaccagcaacttcatcactatcaccaacaccaccatcatcatcaccactatcgtcaccatcatcaccatcaccaccatcattactgtcaccaccatcattgtcatcactattactaacaacagctaatggaagcaagcaactttgcctgctgtttttatccgtcctttagtgtatctctagctcatggaaatggaaggaagaaatgtgaagtttaggagattggagcttccagtctgaggctgatccatacaatacaagaagaaagagagccaggaaaggcccaacaggagggaatcaatgcaagatttgagcctattttgtggaagcccgcccatcagccgtcttccctctcttcgcctccttgggtctcaggaactcagccttcagaagtcatgaactgaatctctcctcccacccccacatccaccagtctctaccaagagtgagtcctcaggaagcagccaccaccattcgttatcacgcggggggactgccaagcattcgtacccaatccagacaccaccactgaaatgaaagtgccctagtcaggtcagtgggcagttcattttctttattttttcacaagctttgaattcagaaataagagccacaacaagttggttgttaagtaaaaatgggagtgattacaaaggaaaactttgtacaaaactttaaaaatctgactgccccgtcaactgcctcagagggaccaggactcaggccacgcaggggcagccatcagccccccatcgtcagccccgaatggggatggggagacctctttctgagtgtgaacctggctcggcctgaagcctagagctggcttgaagaacacacacagaccagaagacagcacggtgagttacaagtgccacggagaccagggtttctgacacaggatgtggaggatgcttctctgcaacctagtgcaaggcttcccctgccattccgagaattcacggatctcacaggtggaggtggggcgagcttctttctagtgtggaccagaggtgggggcaatgagtaaacatcttcactgtaagggttttgggactgcccctcagggcttgaggtctcggcatcgtgtctcagtcagtccttggcgatgtcccctcagacgcactcacagacttgcatacgtaatttagtaacatgcatcaactatcctagaacatctacagggtgcaaaggaaccaccactcagagaatcatggagccagtggagttagaagtggaagggacagaacaagacaatgctaaaacctgtggttcactaggaagggggaatgaaaacaccatgctccgaggtggattcagcatgaacacaactgtggggcaaggaatttccaagcaaacacaccacactagtaccacttcttcctaaacagaaaagggaaagagcatccttcgacttccccctccctccatcagcaccaactaaaactgtgggtttcaaaaacactgacaggaaaagggatggacatgattcccagaatccttcaggctagctcctccgcgcatccacgttcaaccgaggctggtgatgttggagcggccaccagggggcgccacgatgcggtggccggtgcgcctgggattgttgtcatctatctgggcacctgaaagagagcgccaatcgctgctggatgggatctgttagcatcagttccacgctgctcctggaggccatgtactctgccatgcactccactggacccaccttcattcagggctcagtccaggaccagccatgggaagcctccctggcctccacagagtccactgctccctcttctgtgcccctcagtccctgggctccccccaccttcagccctgaccaccttgtggtgttcttgtcaaaatccccagtaaaatccgacattcctgagacaggtgatcaaacacttactgagtgcctactgtgtgcaggcgcacatttggtgctttaacatgttactgcatttagggcacacaatcatactatgaagggggtgtttgtactcccaacttacgggtgagcaatttgaggttcaggccacgtgtcttgcgggacacaggtgttgggtggggaagccaggattgaagcccaaactggttggttttcaaagcccatgatcttaggcacactgtcccacactccaaaggtattttacatattgtgtgtgtacacatttgtatatgcatgtgcatatgtgtgtgcatgtgcatgtgaactccgcaagctggatttacttccctcattggcgataggtggatctgaagggggggggggtggtgtgcagaggttcttaattttaatctttcaaaaccaaccatccattctacttttacctattctcttgcataaagatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacgtaagtaagttagctcactgcaaccacagcattatcagtactgcacaaagccctcttcggcacacagcacaagcaccatcctataaaatctccagcaagcctttgtttccttgcagtcggctcctttcttgctgacctacccactgtaccctttcatactttttctaatacatctgactttctttaccgacaactgtcttggtgaattttttttactagctgcagaacactggccccaggtagttgtcacctgcaacaggaaggagactcaagtttcagtgctaatcatgccttgaatttgggcaatttggagtaagacaccaccccactcccttggcctcatttccttttctgcacaataagaacagtagactagatgagccccttccaactccaacattacatgatttgtctatgtaagccactaagaatttggttcacagtagtgacttttcttttctcccattgtttcactggtagacaatatgtcttcttgcaatacaagtctcccctaaaggcctggaatcaggcctagcacttagtaactttttccttacaaccatctgtaccttgctggttgcatgtctgtactttgaaaatacctgctggaaaaaaggacactaatatggtttggacttttgtcccccaaaacttcgtgttgaaatttgatcccaaagttggaggtggggcctaatgggaggggtttgggtcatgaaggacagaccactcatgaatggcttggtgtcagccttacagtaatgagtaaattcttgctctattagctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtaatcctttatagcaatgtaaatggacgaaaacagacactaactcatggtacagctctataacgtaacatacgcagatattaaaaagggcatctgtgaggttgttatgatgttggaaagcatctgtgttgttggtaccaaatgaagtcacctatcaacctgccaagaggctggctgacagcagtggtgctgtgggcctcaggaggactaagagtgaaactgagagaacaagggtgaggaggggcccttccaggtggcttttaacttcattgttattcttgttctaagaacaacggggaggaggattttctgtccatgtttaattgcaattgtgcagtgtttaattgcataactccagaacagtggtccagtttgcaaactccttgagagcttgtgtcttgttgcacccagatagctttttcccaggatgaagccaatccctggtttgctgattgagcatcacatgacttttagcattctatttagggtccattttgtgcaaaaatatgaaacactggaagctcttccatcaaagtcttatggagagtgagatgaatggggaggcctccttgattcatgcctcctcggcataatcactgaatcagacacttcctgaatggataagaggttctgccaccacacaatctgaattcacacgtcatcctctctctctctctctctttgccccttccactctctcttttgctaagcatatcgcctttcctgaccaggaattagcaaacgggtccattgaccaaatccggcccaccgcctgtttctgtacgatccatgacctgagaatagtttgtacattttcaaatggctattgaatataacatcctagatgttgacatcctagatgttgcctcttagcttacaaagcctaaagtatttactatccggccttctaagaaaaaaaatcaccatactcttagtacccagcacggtgtgcaacccatgcaacgcctcaaagagtttgcaggacaaaattccagttcaactttctcaacgtgtgcgtgcctgccctcatgtggccatctcaccaaatcacagatacactgccctgagaccttaagaaagtcaggagggatcaggtcaacatctaattttgttcccacacatttgttgagcaccaagtcctggtattttgacactggatttcttggggcttccgtttcctctttaaataaatagggtataatgttactttatggagtagtgaggataaaataaaatcatgggttatgaaagtgcttagtacactgcagtgggtgaacaggctaaagacttacacagagcacatgccctgcaaatggcagctactcccatctcttgttcatccccaccactccatgtttactttcatgaggaagagtgtgaaagtgtccccaaatgtgtgtaaggatgagcactgggacaattttggtacctctctttgtaaacccacatcaggtaccaccatgttgcccccctaacatggacccccctctgcttggtgaccatgccagcccactctgccccaccagtgagagcaggctcgggtggggcacactcccttccctgcttcttcatctagtgtccaaggccacgtgtccatttcctcagaagcagcaggaaggactcggcctgaactgctgcaattgtggggagcctgggccaccactctttcctacctgataagctgaagttggactggtggaggtttctgatgggtgggggctggtgtttagaaggcgaagatttggctgaaggagcgggagttgcatatttgggtgtagctggtacctcgtacacaggaccgtcatacatgcccctggaaaccccttgcaatccaaaaacctaaacagaggaagggagagtgtgattgatcgacactgtgcatgtgtgcccttctgggcagataaagcagagccctgcgggcgagagagaaacctgaggtcacttcaaatgtgcatgcacacacacacacaacacgcacacacgacaggtgcacttcacacacatgcagccgcacacaggcattcatacacacaagcatgcatacacacacatctacatacccacatgcatacacatacagacgcacacaccacgcacacgcactcacatacatgcagtcatgcacacatatatgcatgcacatgcagtaacaaaacaggcctacacagtagcatacacgcgtgaacacgcacacacacttaaatcacatacagatcttcacaaaggcatactcacatatgtatacacatgcatacatgcccacacacacactcatacaggtatacacacccatatatacacttacacacacgcatactcatacacacaaagcttcatgcaggaggaccccaaatcccttccaaagagaagtcactttgcctgacactaccacctacccacccccggaaaggacccctgagtcccagacaaggcagcagcaacgggcccatcttcatgtatgttcttgtagaagtcaacagcgaggcaaagattcggggggcagatagtttgttgggagatggttccagaaagggggaaggagtggggagctgagacagggagggagaaaactcagtacagagggacaaggagtgggccaggtctatggggggcagggctggggatgctgtggggaggacacctccacaccagcctgcaggaggacgaggaaggagggcaatggagccacagccctagccccactgggaaagggttgtgggggcagagaccctgaaagcagcagggcttccaggcaggaggctgtcagcctgctgggaactgctgacagcagcccaggtgacctcagggatggccaaggttgggagggcacctgctccaggcactggagaacagcatgtgttcagggacctgtacagggtcccagcatgagtcagtggcagtgccctaacccaacacggggcttcatcctccatatcaggtgacagtgccctgaccccaggcctggctccctccttctctgcaggtgatagcaccctgacccccagctctgggctcctgtctctccataggaggaagccttaattttagcaccaagtttaaagacccagcacctgcacatcatgtcaacggccctcccctctgtccctggagccctgctccccgactccctgggcctcactgtatcctgtgcattctctgtggctgtggcattgcttcctgggtgaggccgttcatcactccctgaagctcaggtggccagaggcaggctctgatgcaggtctctccttcacctggtctagctcctgcaggcatgaaggaatccctgtgcaatgggaccccccgatcctattgctcctgcaaattgctgtcttggcatttggggtcagatatctgccctcacggaagctgactgttaaccgcaggcctcagcttcagaccaagaaggaaatgaagccagccaaggggtgtgtctgcctcttcagtgggtgtcccagccagggatttccatgagtccccttgtcctcatatggcctgctgcctgtgcctggccttgtctcggatctgacttgtttccaccccatcccttgtttccccatccagtgcaaagcatctgtgcgacttggtgtctttgacctggtgctacaccttatggaagctggggagagaccaaaaccagatgcagagcctcccagtccgggctggagcctgggaatgcaggaaggtctctggacttctccatctcaattggtcacttaggaagcatacaaagaacaggaccacacaggtacacacatggccacacacacagagctcaccacatgctcgcatacacacacgcgcacacacacacactccaacacacgcacacacatccccatatgcacacatacacacgtgcatgcatgtacacatgcacacatgacacgcatagacatacacacatgtgcgcgtgcacacacacacacacacacacgaagctggcctttctggcaaacatcagctgtctcatggggaaagcagctgccatggggatgggagggcctggctggggaagatgttggccacgggcgggagtctctctcagctgtgagaaagttccctcctctgagttgctctaaagttaggaatagagcctgctccttccctttgacagatgtcctgaggtcagtgctaaggttgttcaaggaaaataaggaacgacagggcagaaacgtcaagggaggaaggaaaggaagaaagggcggatctgaaggaagccctgcctgcaagatgccaggggtaacaccttgctccacagggccagacccgagggtttctgagccgtgactctggctaagcccttcactgctctgggctgcaaaaggaggatcacagcacctcccgtgggtgggcaggattacttaagatgacgcaggacagcgcccagagcagcttggtaagcgtccctcccatgatccacccaccctcacgggtgcacacccctctacagtttgcaaagccctggaacttgcatgtcctcatttgatgctcactcctgtcctcagacaggagcccaggccagcgtctcaacccatttaacagataaggaaacggaggttcccagggcgatgacattattaactctgcacacgtcagatctcgattccccaagagacgctgtcggctctggtcccacgggtgggcccgctcccctgcagacacactcaccttattcctgattttgacgcgctggtacaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagtgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgagacatatgccctgaagagtttcttctgtatctctaagtatgtccgaggcatgaataactgtctgacatatacacatctctacacagacatttctcagcttaatttttctttacctcagcaattgttccatatcagcacacatacaaaatacttttacactgctacatttcatcaggaggatgtactaccatttatatgcccagttcccaagaataaacagttgggtcattaccatgcctttgctaaaaactgctgaaacagactttgcatccacagtctgcacacgtgaacatgtttctagatgtggagttgggggccaaagagtaaatggattttcatctttgacagatttgccctccaaaaaagacaacactagtttccattcccaacaaaactccgtgagcttacctgacagcctttggtaaacagtatctatgtatattaaactcctgatctcagttgctggcacaggtgaaaaatactatctctaggtggttatttgcatctgtgactgagactgggtctctttttaaatcaacacatgccatttctatatttatttcttacggtgtcactgtgttttgcacattattctatttctcagggtcttggcattcttcttactgatttctaaaagtacacactcaatgttaaagaatttatcctttgttatgtgtgttgcaaatatgtcctccctccctggtcctctgtctctggaactcaaatgaagtaattgtttttgccacacagattattttgtataatttttgtgtagtcagtggtcaaacagaccattctttaccatttctaagttttgtgtcttgcttagcaagatcctttccccttcaaaattatcattctttcaaaaaatgtgtgttgtattctagtcctttcatagctttattttatcttaatctttgaaccatggtttgatttgtttgatagtaaatagtagggcagaggttaagcctcttgggccaggtgttctaacacaattggatgagtaactatcgtttcctaattctaattgtctcctttattgtaaaccaaattctcatatgcagtcagtctattccttggctctcttttcttgtacccctgccaaactgtttggtttattgcagctttatgacacgttttaataactgggatgactgatacccccgggcccagtcttcccttttttcagaactatttcagctactctcacatttctcatctgggaactctgctttcctagctaaacaattaaattttctgatgggatcacatcaagtttatagattagattagaaagaattgatatgttcactatattggatcttctcagtgtaaaagtccctgaatttatgtaagtctttagttttttatttttgtttgtttgtttggttgttttgagacagggtctcagtctgcagtgcagtggcacgatcatggctcactatagcctccaagtcctgggctcaagcaatcctcctgcctcagcctctcaagtagctaggactacaggcatgcaccaccatgcctagttaatttttttatttttttgtagaggcagggtctcactatgtcacccagtttggtttcaaactcctagcctcaagtccccctacctgagcctcccaaagtgctgggtttacaggcatgaaccaccacgccaggccaagtctttagtttttattgctattacaggattttgatttccattctattttccaaagtgatttttgattcttccatagaaaaactatcaattctttatattggtttgtaatctgatggtgtttgatgatttttaggtgcattcttgggggttccaggcaatcacgtctcctacacacagctgttgacactgtgccagcctcgcaggacccaggcagacagtgcgtttccagtgttagcatttgctaacctaattctccctcaccctaaagtggctccactatggagtgattcataactgtgccgagggacacatggattgtgaatgcggaggggcggtgcaaggaaccagtcacccatctcccagctgaaactggccagcccttggggacctgggctgctgtccctactcctgggtgaggaacgtgctgtgctttggtgagaatctcaagctgcagaggtgtgaggaggccctggtcatatcacaaatgccacaccctgcatttcacaagaacactgaattgtaaacatcaattccttcatttcttaaaggtaacatacaaacaatgtaaaaatttaaacaacacaaaacaccatgatgaaaaaacctcttgccatccatgagccccatttccctggtcccctccagggagaactggtttcttttataccctttaaagagcagccactcaagctcatgtgtgcataaactaaacgtggtccatccctacaagggggtattattcagccatcaaaggaacatggtacccatccatgatatagcacggatgatcctcaaaaatatgatgctaagtagaagccagacataaaaggccacatattggatgattccatttatatgaaatgtccagaataggcaaatccatagaaacagaaagcagattagtggttgctagggaatgggggtgagagagagggactgattgttcatgggtacagggtttcttttctggaggtgatgaaaacattctggaattatgattgtacaaccttctcaatatactaaaagccactgaattgtacacttcaaaatggcaacacttatggtatatgaattatatctcgataagaaacttaaaaacatccagatagtctatgatatacaaacatgtatgcatacccatgatgtggcactttgatgtgaatgttttccacaaagataggaaagaataaaagttgtgttttatagaaaagtagatttaaaatctaatcactggtcaatatataaggaatgatctcttttcattgttaaaagtaacatttttttaaaacatataaaaacaaaacgaacctctaagcatttctcaatccatgttctgaaaaaattgcaattatgtggatggcattgctttggacagagaaaatgaaacagacaaaatcctttggtcaaaccacctcacggaatcctcaactgtcctcttgctgctatgaaaagaattcaaatcttgcctcacacagagaggggatgcttccccaagtttaccctgaagacagttacctcccagatgggtaaccttgggtatattacatattgttatgggttgaatcgtgctcccaaaaaagacgtgttgaaatcctaacccccattacctcagaatgtgaccttatttggaaacagagattttgcaggtataattaggtaagatgaggtcacattggggtgtggtaggcgcaaaatccaatgactggcatccataaaaggagaagacacagcagagagggccacgcaatgacagaggcagatgatgtaagggatgccttacccgccatggaagcaagtactgctggggacgtcagacgctagaagagtggcctggaaggggtctgcccccagagccttcagagagagcatggcctggccaacaccttggtttcaacttctaccttccagaactttttttttttttttttttttttttgagacggagtctcgctctgtcgcccaggctggagtgcagtggtgggatctcggctcaccgcaagctccgcctcccgggttcacgccattctcctgcctcagcctcccgagtagctgggactacaggcgcccgccactacgcccggctaattttttgtatttttagtagagacagggtttcaccgttttagccgggatggtctcgatctcctgacctcgtgatccgcccgcctcggcctcccaaagtgctgggattacaggcgtgagccaccgcgcccggccccagaacttttaagagatgaaatttcttttgtttaaaccacccaacctgtggcactttataacagcgtccagaggaaacttacacatgtgtcctctctctctctccattttctcatttatcaataacaatatacctaacttagaagatcgtgaggattaaatgagatgatgcatggagaatgctaagcacgaagtaactacaaaacagtatttggctggattgtgatgataatcagagtgcccactcctgagcatggaatctggtgtggcctctgatcccacactgaaatagtaagaggctgggtgcggtggctcacacctgtaatcccagcactttgggaggcccacacgggcggatcacgaggtcaggagatcgagaccatcctggctaacatggtgaaacctgtctctactaaaaatacaaaacaaaattagccgggcgtggtggcaggcacctgtagtcccagctactcgggaggctgaggcaggagaatggcgtgaacccgggaggcggagcttgcagtgagccgagattgcgccactgcactccagcctgggcaacagagcaagactccatctcaacaacaacaaaaggaatagtaagacaatcccagctcagtctacttccttctgggtccttgtccgccgacctttgactggctgacacagacattcacgttcctttctagataaggatcaccttgtgaagcaaggggcagctcccacagccagatggcggtaggagtgcacaccctgtgctatggttggaatatcccctcaaaattcaactggacattgacttgccattgcaatggtattaagatgtgagaccattaagagctgattaggtcatgaaggctctgccctcattaatggttaatgctattatcacaggaatgagttagttattgtgagactgggcttgttataaaagcaaattcagcgtcctcttgatacttctttcacacttgtcctgtcttatccttctgccctctgccatgggataactcagcaagaaggcctttgccagatgccggcattttaatactgaaattcccagcctccagaaccgtgagccacataaatttattttcttataaattacccagtctgtggtatctattacagtagcacaaaatggaccaagacaccctctcactggcaagaccctctcagacgctctcccattgcctctcctatgtgcacagaccccaagcagtgtgtacacacgtgaaataattcataataaataatagaattgcaagccctgctggactgtacatgtgcgtggcataaacctttctccatgggaagatgatctcaggcaccccgttccctggagatgggggctgtgggaagcaagtagtgttaccagggagcattgtgtattataagaatgacctggattggtgagccggacaaggtcagtgagcagctaccgagacctctgcttctgcaggccatgtctgtggcagccaatggatactccagggccatggccgtgagctgctacaagtgtttcctgtggctttcttatgaaacttccttgtgcctcatgtcctgtccccacacctgtggtctccttctccagtatgtgagcccatactccttctccagtatgtgagcccatactccttctgcagtatgtgagcccatagcccatggggccatgggaacacccactgcagctccatcacggtgtgcacatgcactacttctggcctgtgtgcttgcacagactccagtgaaccagggaccactgtggcctcttgggtctgtgcgtgtagttgttaatccagacccaaggccactcttggccatgcaggagggtgttaaagcaagcccttcagggaggcacagttgtcttctgccatctctgcatgcaccctctctgtgcacgcatctttggtaggttgctggatgagtggagaaatcaaaggcatataagatacaaagcagagaaggcccataactatgggcatggaatgtgaaaaagtgtgcactttagggccaaccctttcctgtctattagcagccagccacaaaaccgagtgggaggtttccgacataccaaatcaaatcctttccagcttgataattaaattgagaaccttagatctaatactttccctcgctgagccctgaagcttacacattataagcagtgtcagatggctgggaacacatgcatccatgggcaggagcaaagagacagagagagaggagaggaagagagagagagaaagagaaggagaagcagcttagttgagcctgctcagatccctcctcccaatctctccaactggaggagaaatgggaatgactgagtcaggctagatatcagatcacatcctagttggaaaattcataaatcatttttaaccagtctttaaaaatgattacaacgaagaatcacttatctcagcagcacaaataggccaggacttaccgacttgtgacttttggctgttatggtcttcaacttgtcggggtcccagatgaccacgtcggcatccgagcccacggcaatccgccctttccttgggtacaggttaaagatcttggctgcattggtgctggtgacagcgacaaactggttctcatccattttgccagtagcctacaggcaagacccacagatgagaagagcatctcataatggggccaggaggaggggcagctgggcacaaatggaagactgccagctgaggccttgcaaggcttggaattctctcctctcccagctaaaaacgtgccatcatcaagaaccccagaaggcccagcctcatcagagaggacatttaattaaccgcacagaggtatgttgacgcaagagccactatgacatcttgtccatgtcaccaggccccagtttaacagaagattaaaaacctttggtttcaggtcagtgatcagagtgagacccagctcttcctctgcaacaggaattctctctctacccactcaacatcccaactcctaacacgtgtgcacatgcacacacacagcgttacagagccatttccacaggaactaagacgtggttgagaaacaaaacaaaacatttttcaatcttaagatgtaaaggacaagggtgacatccacaaatgcagaggcctctcccggacttgagctactatctctcaagttatgcgttccctcctgcgccctcctagtatatctgcttccgcctccatgtaagaagggaacttttaagaacccagcgtgcataatgcatcggctttcacagggcaggtagagtgtttctagaatgctcctgagaagagatccagccttaccaccgccttgtcccagacgaccgtcatccgctcctctatcccgttgacaccctcggggatcagggtaaagttgtccttgcccaccgccttctgggcagtgctgtagggacagtggccgctgcctgtgacctgcaagtccccactggcaaggacaaaacaaggtagagttcagaccctagttcattttgaaggcaaatcctgacttcagacaggtacatgcagcacagccagtgaatgaatgaatagataaggaagccagtgggtaagagagactctctagcgtgtgcctgcacgtgtcacaagtcagggatgccccatttatgtcactggcctcatgctttgcacgttacaaagtgagtaatgtgtgctgacatttgtcttcttgacataaggcagttggcttaagggctggccagagtgtttgtgctgtgcttgcagaacaaacactattcattggttacagcaaagtggcacaagttcactgggatttacccttttgtcccctggtgttttaaaaacaaatactctttgatatatcaggtgccctgagctgaacacctaagacaataaaatgaatggaccaggctgagtgtggtggctcacacctgtaatcccagcactttgggaggctgtggatcacctgaagtcaggagatcgggaccagcctgaccaacatggcaaaaccttgtctctactaaaaaaaaaaaaaaaaaattagccaggcgtggtggtgggcgcttgtaatcccagctactcaggaggctaaggcaggagaattgcttgaacccaggaggtggaggttgcagtgaaccgagattgcaccattgcactccagcctgggcgacaagagcaaaacgcagtctcaaaaaataaaataaaataaaataataaaataaaataaaataaaataaaataaataaaataaaataaaataaaaaatgaatggaccattattagtggttctaaatgcaaggtgaggaaggtgaggctgtcctccaatccagaggcccaggaaatgttagcaattgcctagatgcagaggagtatatttagaagttttcttcactcatttattcaacaaaattgtgttgcatgcttcctatgtgcccggtacaatttaaggaatggggactgcatctaagatcagaaagagagagcttctgcatgtgtcagctatactgagggatgggggagactggcaataagcagaggcgaatggggcacatgggcgctgttagagtgagtgtcagggattcaaccaaagcaggtggggatgaggcgtgctggggacaggctggagatgccatttccaggaggataatcagaaaattacgtcactgaggagccttctagcaaagatctgaaggaagtcacagagcaaaccatgtggcgtctaagaaagagggaactagccaggggttcccatgagtgtaaaggccccgaggcagggtcctgcctggggttcagggtcagcatgaagctgggactggaccgagggagccaagggcagaggaggcccagggagggaggttggtcagggcgtgtgcaccggattgagttctgccttgttggatgttgcagggacttgggtttcactggcagaggacttactggttccaagcagaggggtgcttgatctaatctaggttctaaatgtctgacagcagactgtgatgggtagggtggggtgggcccgtgtggaaatagaaagtcttggtcggaagccagggatgatggtggcctgagccaggatggccacagcagacaggtgaggcgttgtcagactctagggcctctggtccgtgttcctgacattttcttagatgggcaagactgtgggactagcagctttatgggggaagatctgcagttctttgtaaacgtgagctgcccaccagacattggactgcagatgttgagtaagcccttggctacgctagtcaaaggtttctgtatcatcagggggatggtgatttccacgtgggcgcacaccactgccccctcctccaaggttccttctgccaagaagccccatcttatcctcccctattgggcaaactcctactcatccccaagctttagtcttgatgccccctcctccagaaagccttctgcaagcctcccggtgggttctgagcatgcgtctctgcttccagagcggcctggacacttagcctcgctgtgtggccctgctattgctaagtgctcttccctcctggtggctaacagaagggaaggggctgaggtgctgggctccacagtgtgcgtgcaccacagcaagtgtgctgcaggcagcagcggccacttctggagcactcggttccaggtccttttcctgcactgtcccataggcagctctgccacaggtactgtctgcttccactttgagtaaaacgagggagacagagagatgtcacgggtgacgtgccaggtccggggtgacacagccttgtctccatccctgatcctgagtgcttcccgatacaccatggtgcctgccacagagcaggtgcttaacagtaggttggctcaacaggaggtggtcaattgatgtgaatggaacagtcactggatgccacagatcttcaggtccgtgagggcctgttgtaagccatatgagcgcagtccttgcagagcacggggcagagcctcctctacaatcatgagtccaaaccagcctgcggattcccaccattaactctctgcctccaaaggccccagctgcctcccccagccccacgttctcacaggtctcaccaggccagtagggaggtcaagtagtcgggcgtggtagggtccgggctcaggggaggggaagtcacgaacgccgcagccttggcccagttcttgctccagtaatgggtgccatcggtccccaggctggcggcaatgggctctccaaaaactaggggcccttaggaggggaaaacataagcctggttaaaagcaaatactctcttgaggcagatgtcaaaggcacaaaattggaagactgtggagggagaacggggctggctgaaggccagaacactggccaccgttcttgcaggcatcaccgcctgcaccgcagggaccttgggtgtccgggcccagctccaccacattgtcggcgccccgccacgcgctccatggggcgtacggcagctgactcacccagcaacctgtggatatggctgttgcttttacgatttggacattattatgtccttttatagatttgtaagccaagccatggagacacgatttactctctcagttagggttctgccagaagcagatcttaggaatctagttcaagagtcttatttgggaggtgattccaggaaacactggctggggattgaggaagtgacataaggcagggaaagcagccaataaagggagatttctcatcgaggcacagctgagggccctggcactcagtcctgctcgggaacacgcctcagggtcctcccaccccaggggaaagggagttggatgtgtttctgtcagcccagtgccggagggcggcttcccgagcactaacttcccagaagttcctgcttgtctttcaaggagtcggcctggcgggcttcttccagaaaagcctgcaggcagaggctcgggctccccaggaaagatctttgcattagagaccaagggcaagagatgtggcccgagaccccctgctgccctcgcctgaggccacctgctgcccagtaggagaggcagctgcaagctctgcccggctctagggcagcccatcaagcagcgctttctgcagcgaggggggtgccctgtatcacagctgcccaaccagcaaccaccggccacatgtggctgttaagctggtgtggctggtgccactgagaaactaacttgttcattttacttaacattacttaatttaaatttagatagccacgtgtggttagtggctaccttatggcttcctgtagctccagaacctgcctgcttacccgctcccggctggtaccgcttccagatttctgtaacctctctgagccccggtttccttatcttcaaaatggagctagtttcaggcaagctgtgctgttctagcctctacttgtcagcttgcccttaaaaacactaaaacaacatatttggggtccacagctgctctgtccaataaggcagtcctgagccgcatgtggccaccaataacctgaggctgtggttagtctgaactgagttgtgtacatgtaagatactgaattttgaagagagtacagaaaacatcatgcaaaatattaatgatttttacattgatgacatgctgaattaatatgtggatccattagattaaacataatatattattaaaattctctttaaatggagctgagcttatcgaggtgaatatcctaaggtcattgggaccaaagaattccagccaccatccttgtgtcaggagcatccccgctccacccctccctcctccggctgcctgtctgagttcgggagggagtgaacttgaacctgcaggacacccccttccaggccccagctgcccccagaaggcccagggccggctgcatacctttcttcctggccagagcgatgatgtcggctgcactcttgctcatgaccttggtgatgtacacagggcagttgatccggcccgcaatggtgatggcccggaacaccgcctcggcctccagctgaacacggcacacacagtgtcacaggagggaaggctggtgtaacagctaccacccatctccattttccttaattgaatgtgatcagaagggaaatctgctccattgaatgagaaggacatactgagtccaacagcgcttgacagtgccccctgctctccggggtggagcattggtctcacgctgggatacggcagcaacatccaagcgctatacaagtttatagcactgcctcccagttctgtcctgacctcaccatgggccaggaacatacagctcgtggccatccctgggctgtggagctcatgaagagcactgggtgggatctcaagcccctcaggacacggaacctgtccactcatgtggactcatgtctgtgtcccctgtgtccagcagacaccaggcccagggcatgggcccagaagactcggtaatgacctgatgaggacatcagaaaatgtcctcaacttggccaggcacggtggctcacacctgtaatcccagcactttgggaggccaagacggatggatcacttgaggtcggaagtttcagaccagactggccaccatggtgaaacccagtctctattcacgaggtcaggagatcgagaccatcctggctaacacggtgaaaccctgtctctactgaaaatacaaaaaattagccagtgtggtggcaggtgcctgtagtcccagctacttgggaggctgaggcaggagaatggtgtgaacccgggaggcagagcttgcagtgagccaagatggcgccacttcactccagcctgggcgacagagcgagactctgtctcaaaaacaaacaaaacaaacaaacaaaaaacacaaattagccaggcgtggtggcacaggcctgtgcctagtgctcctagctacttgggaggctgaggcaggagagtcacttgaacccaggaagcggaggctgcagtgaaccgagatcataccactgcactgtagcctgggcaacagagagagactccatctcaaaaaaaaaaaaaaaaaaagaaaagaaagaaagaaagtaaaaagaaggtgtcctcaactcaaaggatggctgccagggtgcccactctattccatgcccgatcagcttgccttcctccttccacactccctgcaggtgcatgcacatgcacccacactcacacactctctcacacacacacacacacactcactcacacacacacacacgcactgtctctctcacacacacacactaacatacacacactcacacacacacatacacacacagccagtccaggggaagtcatcctttttcaaggcttgggaacagggcaggcagtgggagttgtctcctgggtgctgggcttgggcatgcggctccactttcctattatccactatgccatgtcctccatgagaatccgtatccacttgggacactgaagcacccacggggccttggagtgaagttccaggaccctgggagaggcagcacctcttcctgtcttctccagccagcagtccccagggttcccggggaaaacaagatggtttgggatggtctgggagaggacacgggaagaggccgggtcctggctgggctactccagctggaacagcatcaaggtgagtgctcagtggtgagtgtcagagtcatgcccaagttgaggagtccttacctcttcaggtctgctcagggcatggccctcgggacccg

SEQ ID NO: 9189 - DNA, 425 bp, Homo sapiens
ctaagacagaaaatcggtaacagaagtggggtccacagaactagcaaacactacaaacaagggctttctaccccacccaccttcacccattgttcaacattgatttggcagcacacttctggaccactgaatcagaagggtcaatcacctgacttacaacaaaggccccactgcatcttaatgggggaaagaatagtctttgcaataaatggtgttgggtcaatgggagatcatatgggaaatggagaaccttcagtcctaccttatattgtacataaagattattgagagatggctcagagacctaaatgtgaaagataaaacttctagaaaaaacccagaagactactgtggtaggcagaataacgctccccgtccctgccaacaagatgaccacatcctaatccctgggcctgtgagtatgt

SEQ ID NO: 9190 - DNA, 349 bp, Homo sapiens
agtgtgcagttcggtgctttgagtaatcatttgattcgcacctgacgtcccccctggaatgtacaccattgaccggccacatgccacctggcatataacaggcattcatggtcacctggtggaaggaagggagggaggcctgggaatattcctttcctcctgtggcaactggtttggaaggaagggagggaggaacgctgagtatatactttcctcctgtggtgtatggattggaaaggaaggagggagggagggaggccaggaatactattttccccccatggcttatagatttggctgtgtgtcagcattacccaggggctcattaaaaacaacattcttagcccca

SEQ ID NO: 9191 - DNA, 832 bp, Homo sapiens
gcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggtagagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggaga

SEQ ID NO: 9192 - DNA, 5230 bp, Homo sapiens
cctctgtctggcattcaagtccttcatgttctgagtttgtaaccagagagggtcttcggccccttagcacaggaccagacttataattagtgacatggatatttgttgaataagtggctgaataaatgaattttacttctctaacctgacctctctcttcacccctctatccagagccacacttatgctcacttttaaatgcatttttgcacacactatccctccttcctagaatgtccacctctctccaggtcatggtgtcacctaaaggaagccctctctgactgcgccatccttctgtgattgtctctcccccgccagcctttccctggcatcaagtacacactaactaccctaacatgggagttgtggttcctgaaaaacagggggcagcctcctctttttgccccccactgtctgcctcaggttgtgcagggccaggtactatctccaccaagcagcaggggcctggagttgggatccctgcctcagtccttctaggagcaagtggtttcacagtggaggcccagcccaggctgccctgagtagtaagacagggtggcctcaggggcaggacacagcttccttcccatgttctcctgcagagaagcagcgggagctggcccggaagggctccctgaagaatggcagcatgggtagccctgtcaaccagcaacccaagaagaacaatgtcatggcccgaacaaggtagaggccctccctaccccacctggaccctgccagccaggacctatttctgctggtcctgagcctccccctcttccctccctcctcaggcccagctcctctctgagaggagacagccttaacaggatccaaggtggggagggagggaagaaagtggtgggacggggcccaacccagtcccttgccaggtttctatgctccactttgccactctaactcccgaaattcttcacctaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctccagggatgggaatttttttacaccagggactgggggttgaagagaggtggcagagagaggaaaggggggcctgcgttgtctgctgtcatcctgggacaactgatccaatggttgtccctaattggcctgtgatgttgtctctggacagcagaatatgatgcttaatgccccatcccctcaggaaggagccctactccctggaaaacacctggctagacttggactttgggaatatcctacaagtcagggtgatttgagtctacaaaaaaaaaaaaaaagatgagaagggggtgaaaggagtaactgctatatttagaaggaggttaaggatagcaattgattttaagggtggggctagggaacttgtctttaaaatcctgcatttgcacagcaagcacagttcgtattgagattttgctatttggaactgtaagggaggtataggatgctgcctaatgggaggtgggattgcagagagttttctatgtaatttcttggtatcactttccctctctttcctccatggccagcgatgatgactttgacatgtctagatactcctcctccggctactcctctgctgaggtgagcccctaccccttctcaccctagacaccaccgggcaggatcactgccatcccgggggagggctggggccaatgcccaagtacaaggaaaaagagggctgggcaaggctgggtggtgccctgcacagggtgggcctgggataggatggaagagaagtggttactggcctcaagtgcatggagcccagggttaggagtggggctttagattgcagcaggccatttaaatagaatgggtgtaaaatacaggtgatatcctctagtagccggcctgagataggggcaaaacccgaataggagcaggaccagaggtgtgaagttgaccatagaatggggaggggtgactagaaagagaggccagaggcgaaggagggcgcctaggcaggagcggggcctgggggtacagacagaccccggacagggcggggctgatatccagggcactggctggactggggcgcagacgggcctggagtggccgcagagctgtgggtggtgcctccctgccggtcgggcctgacctccctcccctttgcctacagcagatcaaccaagatttgaacatccagctgctgaaggacggctaccggttagatgagatccccgacgacgaggacatagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagtaaccatcactgggtctctctccacccggaaactaaggacgggtgggggccgtttgttcagttacatgggggaacctcacccagcaccgtgccccgcttcccagggctggccaagagagaagactgcacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcctaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatatatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccgcagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 9193 - DNA, 414 bp, Homo sapiens
cttcccagggatggggctgagccaggtgatatcacaatgggcagtgcccatcctggagggggcatcagtgtggggtgggagcaggaaggctgttggggaaggaagctgagagatcctctgcaggaggggattatagcagctaagggcacctgccaggctggaggtgtggcctgtctaggggaagggtggtcactgatgtccagcaggagcccttgacaggtagagcccaccacggcatctccaagaccacaccatgttcctgttctcccgtaagaccaggacccctatcagtacctacagtgactcctacagggctcccacctccatcaaggaggtctataaggacccacccctgtgtgcctgggaagccaacaagtttctgactccggtaagtgggagattggtggggagggg

SEQ ID NO: 9194 - DNA, 3029 bp, Homo sapiens
agtataaagactgaaccaaaaggagacagaagacaggctgggagatcactcaggcaagaacttaaggcaaaatcaggggcaacagatagagaagggaagaaatttgagattcatttcagaagttgacaggacttggtgattaagctaatccaacagagaaaaggaaaagtcaaagatgcttccatagtttctagtttaggaaatcagtgatgacatcaattgagctaatgcaagaacaggtgaagtgagaagattaacaattcctgtgttgaagataatgaagttcaaatacctctggaggcagggcaagttacccaacaagaagtcaggctttttaagtttgaatttcaacaacagggtcgagaatgggagcacatgaacactattactcataagagagaattttaaacctgtggacacagtcttaccctcgatgcaatttcactccatcttgaggcaactgtcaagagttgaccagtttcatttactctcatagttgtaaaaattccacaaaattgttaaagtctctgtaagcgataactttaaacagtcagagcttttgtcttgttctgagtcatttttcccctttcctctttgtatgccattctttctgtcaaactatctagttaaggaagatatgtgaggtataaggatgcataatataaaaaaatttttgctattcttattaaacattttgtcttaattgtaaaggtaaagaaaagaacattcgactattctaactttaggaaaacctaagttaaataatgatttacctatgtgactctccactaattttctcttgcaaatcatcaccccttaattaactgacatccccaaggcagtcaactcaagctgtagctttaaccacagaggttaaacaattcacagtcctgttgttgctgtcagaaacccaagttacactgtacctttgtctaatcaatggtgccctagtttggtgggagatggagaggaagggacctgttggcaaggaaacagctgcttccttcctgaacaagggaaaaccagtaaggtgacagatgggcagagcagaaaagtagccaaaaattgctgtggctcctgtttggcaataatttctggaactgaggcacaactgaatattttaaagtatatcaacaattgagagagtattgtttacctgagtgcgccaaagttcaacaagccttcccacacgtttcccacatttgaaaaacttttaagtttgcagtagtacaaagagcttagccttagcctatgtatagtgggcaaagactgcaaggcactgtcccatttcactttaggattacacccaagcaaatgcactttccggttaaaaaaaaaaaggaaaaaattttattttctctatagtagttatagttgtatgactgactagaattactattaaaatctcattaaaaatgtttttcttaaaagtttacttttatatacttaatttgaaaagatttgttcaaacttttataatttgttctttaatcattccccctcccatccacttcagtacccagaaaactaaatatccaagaattcctgggtaaaacagacaaccactagatagatataactaacgtatttttttaagctgtatagttcttcatcaaatggaaatcggcaaccactgaaaataacattaaaaattagtgtgggcatgaagtatggaattttaaacatcagtttactatgctgattaagtcaacatttatattttcatcagaacttaataatcccataaataaatagagctctcagttatttaaaaaaatcaagggataacatatgtatttagacatattagcagcgtaaagatgtatgcttcaacacacttattggggaaacgtctgaaaatattactacactgaattcaagggtatccaaaggaacctgacatagaagttctctagaataacatcatttcagggaatttcaaaaaagaaaaggggtcaaataggaaatagcctcaaattaattgacaaagttcagtgtttgccccaactagattattctctctctccactgcaaaaagaaagtctcaggatgagtgaatcacttagacgaaagttcatctagtggaataaatggagaagccgcttgggcaggtgacacaggagagtcggtggtagtgctgactttcgctggtgagttacaagaagatccggcactgctgctgtttccatcaagggtatccgaagatacacacacaccaggatctgacagctgtgcaacgtcagaagaaagcatgttggtgatgccctggaaaaatctctttggctgatattcagtttccatttcacattttcttttcaatggtccaagaacacttggtctaatgcaattgatggggctctggcttctccgggtggtaaatcgggtcgttgggctgggaatagggcttggaggcaatccgttgctacttacaaaactttgcaaggatggcgaaaaacactgcttcccaattccccgagtgggtgacggtgctggtgacacaggaatgaaatcgatgcgcttgggggaggcggatttctccacgtcgttgtcactcaggctgaaactttcctcccaggagtggcttatctgcattgcggtctgcacctcccgttcgtggaccgtctctcggttgatcaagtccatgccctcttcttgtttgatctggtgcaagcggctgctgtgcatgcggacaggggaggccggcagcagcaggccgtggcggctcgggaacgttgtgctgttccgcctggcgctcggcgcctcggcctggaacaccggcgaagtgtcactgaggccgtggatcaggggggcgctgttagacctcctgaggcccccgccgccgccgctgccaccgccctccgccgggctcccgcccgtacccgcaggcagctccaggtctagctccatcttctcctgagccatgtcgggggcagggaggcgggggaggtgctcagtcagggacctaggattcccattccccgcagtccagggccgccgccgctgccgccgccaccgagaatctgtcagcg

SEQ ID NO: 9195 - DNA, 4551 bp, Homo sapiens
tttcctcatttaagtcttgattccttccccaattttattgccaaataaactggtctcttgctacaggtatgtaactggttgaactaataaatgtgaatcactggaaggcaatctgatacaagttattcttgattacaatcaatcttttaagtatgcttaagggtcctaacatccagcagccttggagttaatgatctttaatgatttctcccatttatactgtgtttttaacaagcataataaaggaaaatataccagaggtttattaagtatgacaaactgtactttaaataaatgttgctattgactttaggacttcttgcacaaagtttatagattagcaatactaataccttaaaaatgctttttgaaggataattcttacacgagctaagtaagcccttacagtctacagaataatgatggacgttatgaacaatactatgataacgtaaattgtccacatgcccttagaaccttatctgatttaaaaacttcccatctatatagaagaataagcttacagaaataatgtttccataccttcggggaaaaggatctaaaataggagagaacatgatgtatttaaggaaaagaaaggcaagccagtgagggcgaagcacagaaaacgaggggggaggagggaaggaccaaattcctcagggcctcctagcccagaattaatacattttggcatactcatgagaacaggaagcaaatgaaaagcgttcagctgggagatggaaggatcaggtccgcaattttaaaagaatgactctagttgctgtatggagaatgaatggatagccgaccagagtgagtgtgaggagcacaagtgggagttaggaagttgcttcagaagcctaagagggaaatgctggtagcctggatcagagtggcaatagaggtagaaataaggagatagattctagctgataaaaatcagtaagacttgaggaatgattagatatggggaaaagtaaagaagagaggtgtcaatgacatgttggtttcctgcatttatatacatatatacatggaaatgccagtaacacatcttgtacaatagatatcaagttgttaacagaagttatctgtggaaagggaagatgaattttacataattaaaagcagacttttaaaaccacacagatatgtacaatgtttaaatattttacaatcagcaggtatacattgccttcatacttaaactcacgtgcaatttgcctccctgaaaaggataggaattatcccaaagaacagacacaagaaaagtacatgacatatttaaagaatatcaagtggtctaatgtttgcagaataagaaggaaagatgtatactggaacagagatgaggagaggattgaagctatttcagaatatggccagatcataaaggtccttctatctgaggctaaagaaatcattccttaaagagtaggaaatggggaagcaagtgaagttttcaagcaagagggcgaaaaatatcaagtttaaatttcagaaagattactcaagaggcagtataaagactgaaccaaaaggagacagaagacaggctgggagatcactcaggcaagaacttaaggcaaaatcaggggcaacagatagagaagggaagaaatttgagattcatttcagaagttgacaggacttggtgattaagctaatccaacagagaaaaggaaaagtcaaagatgcttccatagtttctagtttaggaaatcagtgatgacatcaattgagctaatgcaagaacaggtgaagtgagaagattaacaattcctgtgttgaagataatgaagttcaaatacctctggaggcagggcaagttacccaacaagaagtcaggctatttaagtttgaatttcaacaacagggtcgagaatgggagcacatgaacactattactcagaagagagaattttaaacctgtggacacagtcttaccctcgatgcaatttcactccatcttgaggcaactgtcaagagttgaccagttccatttactctcatagttgtaaaaattccacaaaattgttaaagtctctgtaagcgataactttaaacagtcagagcttttgtcttgttctgagtcatttttcccctttcctctttgtatgccattctttctgtcaaactatctagttaaggaagatatgtgaggtataaggatgcataatataaaaaaatttttgctattcttattaaacattttgtcttaattgtaaaggtaaagaaaagaacattcgactattctaactttaggaaaacctaagttaaataatgatttacctatgtgactctccactaattttctcttgcaaatcatcaccccttaattaactgacatccccaaggcagtcaactcaagctgtagctttaaccacagaggttaaacaattcacagtcctgttgttgctgtcagaaacccaagttacactgtacctttgtctaatcaatggtgccctagtttggtgggagatggagaggaagggacctgttggcaaggaaacagctgcttccttcctgaacaagggaaaaccagtaaggtgacagatgggcagagcagaaaagtagccaaaaattgctgtggctcctgtttggcaataatttctggaactgaggcacaactgaatattttaaagtatatcaacaattgagagagtattgtttacctgagtgcgccaaagttcaacaagccttcccacacgtttcccacatttgaaaaacttttaagtttgcagtagtacaaagagcttagccttagcctatgtatagtgggcaaagactgcaaggcactgtcccatttcactttaggattacacccaagcaaatgcactttccggttaaaaaaaaaaaggaaaaaattttattttctctatagtagttatagttgtatgactgactagaattactattaaaatctcattaaaaatgtttttcttaaaagtttacttttatatacttaatttgaaaagatttgttcaaacttttataatttgttctttaatcattccccctcccatccacttcagtacccagaaaactaaatatccaagaattcctgggtaaaacagacaaccactagatagatataactaacgtatttttttaagctgtatagttcttcatcaaatggaaatcggcaaccactgaaaataacattaaaaattagtgtgggcatgaagtatggaattttaaacatcagtttactatgctgattaagtcaacatttatattttcatcagaacttaataatcccataaataaatagagctctcagttatttaaaaaaatcaagggataacatatgtatttagacatattagcagcgtaaagatgtatgcttcaacacacttattggggaaacgtctgaaaatattactacactgaattcaagggtatccaaaggaacctgacatagaagttctctagaataacatcatttcagggaatttcaaaaaagaaaaggggtcaaataggaaatagcctcaaattaattgacaaagttcagtgtttgccccaactagattattctctctctccactgcaaaaagaaagtctcaggatgagtgaatcacttagacgaaagttcatctagtggaataaatggagaagccgcttgggcaggtgacacaggagagtcggtggtagtgctgactttcgctggtgagttacaagaagatccggcactgctgctgtttccatcaagggtatccgaagatacacacacaccaggatctgacagctgtgcaacgtcagaagaaagcatgttggtgatgccctggaaaaatctctttggctgatattcagtttccatttcacattttcttttcaatggtccaagaacacttggtctaatgcaattgatggggctctggcttctccgggtggtaaatcgggtcgttgggctgggaatagggcttggaggcaatccgttgctacttacaaaactttgcaaggatggcgaaaaacactgcttcccaattccccgagtgggtgacggtgctggtgacacaggaatgaaatcgatgcgcttgggggaggcggatttctccacgtcgttgtcactcaggctgaaactttcctcccaggagtggcttatctgcattgcggtctgcacctcccgttcgtggaccgtctctcggttgatcaagtccatgccctcttcttgtttgatctggtgcaagcggctgctgtgcatgcggacaggggaggccggcagcagcaggccgtggcggctcgggaacgttgtgctgttccgcctggcgctcggcgcctcggcctggaacaccggcgaagtgtcactgaggccgtggatcaggggggcgctgttagacctcctgaggcccccgccgccgccgctgccaccgccctccgccgggctcccgcccgtacccggaggcagctccaggtctagctccatcttctcctgagccatgtcgggggcagggaggcgggggaggtgctcagtcagggacctaggattcccattccccgcagtccagggccgccgccgctgccgccgccaccgagaatctgtcagcg

SEQ ID NO: 9196 - DNA, 175 bp, Homo sapiens
gcctgccatccaactgcaacctggcatccatcatagcctaataagccttctacttgtccttaacttactcctttagattctcagaggcaacattaaacctttactgcactcaagcttccaaatgatctcctgtccctatcctcatgtatcttagattcctcaataattggaaaat

SEQ ID NO: 9197 - DNA, 2727 bp, Homo sapiens
ggaaattctatttttaaatacatgctactttaaataaatgttacttcatcatttgcaaatgactattcaatcaacatgtataaaagttgtggatttctttgcttttatgacaaaagtggtattgtatttttaaactgatcactttattaggtcagagagggtatagttcaaagtgtaattatttattgttaaattgtatatttacaaacattttagttttgaaccattagatatttatgtaatttaagtatgaaagtttaaaaatggttcatataataataggcatgtgataaaatgtcatgataaaagacagccaaataaatattatttcatcctacttagaaagaataattttccagaggaactttactcagttttagagagaaatccaagaatagtgttcttctttcatttttcaacatgatataatcagagaatttggaaaactggtaaatataacctatagtaaaatggtcaggaaaaatactcatttccatttatgataactgaagtgacaaaaagactcctagaagttacattttccctttgtggtatattaaagaacaatgaatataccacactttattctaaaaaggactttttttgtgaatgtaaaggataatgatcagatttaagtttctttctacaaccacttctaattctattcacgtgatctatttaaaaattccttacttcaacatatttaaatgtagtagccattttgaaacattttagtccctcaagatacagaaatatacaaaaaacatacaagtttcagatccagaattcagtttctccctaaagggaaattcatcatccaatcttctggcgttctttaaactagacactagacccttttcatctagatattgcatatctcatatatattatacatgcatacatgtatgtgtatgcgtgtatttttaaaatcagtatttgtagtaacatatcaaaaaggaatttctaatattccaaggttctaatgttagaatagaaacatattcacaatagtgtttaccagtttcatatatttagagtagtttcacactaaaatgagtgattaggctaggcacggtggctcatacctgtaatcctcgtactttgggaggccaaagcaggggggcttgcttgagctcaggagttccagaccagcctggggaacatagtgagaccctgtctctacaaaaaacatttttttttttaaattagctcctcacagtgacacgtgcacctataattccagctacaggggaaactgaagtgggagtatgacttgagctgaggagttagaggcttcagtgagccatggtggcaccactgcactctatcctgggtggcagagtgagagcctgttgcaaattaaaataagtgattaggacaaaaaagatatagggccaaataaatagaatgcttacccacctcaaataaaaagaaaataatatttgttaatatgaaggtgatactggataagtgaagtgcctaggacttttttcttaaataatctagtatattttatgtgaataagggactataaagtagggagatcagcaggactgtaaaagtgggtgtgggagaagaaagtttgctagtcaaacttggtttaaattgactgcctttgtaatagcatgtggctgaatgttttgatctatttataatgaatattttaaggatttgctaatttttgaaaattggcaagaaatactcatttttttcctgtcttgaggtatgccaaaaataaaacttgctagaataaaaaaaaatgaaagtgaaggaatgtcttgtgtgtgctaaaacacctccacttaaagagtttgatatccactagaaaatgttgtttctttaaaaaggggacaaagggcatttgatgcttctcacctttcacggttgtgacaattctcttagacatcttaaattctctaagtggagatttcttatattcttcacagtacacctgtttaaaaattgtagtccacagaaatctgaaactacaaaagaaacttttctcaagatgataactcacaaggagtgtaaattacagttacttcatttgtgggagttttcctatcacttttcaattaataagacaccctggttatgggaattttagtctcactgaaaaactcaatttttctatgcaaattaaatttgcgtatgcaagttacaatttgagtttaagcttaggcctacgctgatggagggataacaggcaaactggaatgtggtacttgaccatacttagtcagtgcaggaaaaacaacaaaaaaatcttcagaaactttcttaccattgacaggggctagtgtcgatattccttgtggttttcccttattgactgtatctacgccatcacatagcaaaatgtacacaacagcagaaagtagacattttactcatagtttctgcaaaatctgaataaagataaagtttttctattataaataatgccaaagatgtggtcttatagatgtatgcattctaaggatcagggaaaggctgtgaaataaaactctaagttgaacaaaattcaagtagtttatcttttaacagaaatatctccataaaccatatcgatataaaggtgaacaggggttggacacagtggctgaaagcccataattccagtgttttgggaggccaaaatgggaggatggcttgagaataggagttggagaccagcctgggcaacatagaaagacctcatctctacaaaaaaaaaaaaaaaaaaaa

SEQ ID NO: 9198 - DNA, 2721 bp, Homo sapiens
ctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggtaaatgtgaagagtgttttatgacatttttgaaataataaaaccatttaatttttttaaccttgacatactaatatacacaaagtggaagtaaaatatttggtctcctttattataaggtatcaggaaaggttttactgagtttgaaagatacataggaaattaaacacagaagccagaaatacaagcttaaatgtgatgatgcttttttctttttacgagattggaagacatttgtgtctggatttgttttgttttgttttgtttttcccttaagaagagctatttgaaccaggagtggttttcaacataccgaacagataattgcatgggttttaacctatcaaaatggtcatgcgttcagtcataacaatcatgatacccttattagtgtgtgtcagtggagtaacagtcttccttgcatatagctcaaccttagcttttatcaccttcctccatggtgcaactatttcattgttgtctaaaacatctattttaataaaattaataagctgtctgcaaaattatgatacagctatagaagcacaagttctacttctaggctgtcacagttttttggttgcattgaagaatgttcatgaatgattggtttgattaatgttaatgagttgaaacattttatgatgtttttgtggctagttacacataaattgccttaaatacatgtattcattttgttacttttaccacttttattatttattatatgctcagaaatttggtagagggaaaagctagtttaaaatttcatttttttatgtttaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctca

SEQ ID NO: 9199 - DNA, 1728 bp, Homo sapiens
  misc_feature (1591)..(1591): n equals a,t,g, or c
  misc_feature (1608)..(1608): n equals a,t,g, or c
ggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggtaaatgtgaagagtgttttatgacatttttgaaataataaaaccatttaatttttttaaccttgacatactaatatacacaaagtggaagtaaaatatttggtctcctttattataaggtatcaggaaaggttttactgagtttgaaagatacataggaaattaaacacagaagccagaaatacaagcttaaatgtgatgatgcttttttctttttacgagattggaagacatttgtgtctggatttgttttgttttgttttgtttttcccttaagaagagctatttgaaccaggagtggttttcaacataccgaacagataattgcatgggttttaacctatcaaaatggtcatgcgttcagtcataacaatcatgatacccttattagtgtgtgtcagtggagtaacagtcttccttgcatatagctcaaccttagcttttatcaccttcctccatggtgcaactatttcattgttgtctaaaacatctattttaataaaattaataagctgtctgcaaaattatgatacagctatagaagcacaagttctacttctaggctgtcacagttttttggttgcattgaagaatgttcatgaatgattggtttgattaatgttaatgagttgaaacattttatgatgtttttgtggctagttacacataaattgccttaaatacatgtattcattttgttacttttaccacttttattatttattatatgctcagaaatttggtagagggaaaagctagtttaaaatttcatttttttatgtttaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagcattgtgaaacagatagttatatgtntgcacgtcaaagatcancttaactattgctgcaacaggtttttcttaatggttatcctcttaaatacacctgctggtacttggtgtggttaaataggaaaattgttattaaataaagaatttgtatgaacctttgcc

SEQ ID NO: 9200 - DNA, 2733 bp, Homo sapiens
ggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggtaaatgtgaagagtgttttatgacatttttgaaataataaaaccatttaatttttttaaccttgacatactaatatacacaaagtggaagtaaaatatttggtctcctttattataaggtatcaggaaaggttttactgagtttgaaagatacataggaaattaaacacagaagccagaaatacaagcttaaatgtgatgatgcttttttctttttacgagattggaagacatttgtgtctggatttgttttgttttgttttgtttttcccttaagaagagctatttgaaccaggagtggttttcaacataccgaacagataattgcatgggttttaacctatcaaaatggtcatgcgttcagtcataacaatcatgatacccttattagtgtgtgtcagtggagtaacagtcttccttgcatatagctcaaccttagcttttatcaccttcctccatggtgcaactatttcattgttgtctaaaacatctattttaataaaattaataagctgtctgcaaaattatgatacagctatagaagcacaagttctacttctaggctgtcacagttttttggttgcattgaagaatgttcatgaatgattggtttgattaatgttaatgagttgaaacattttatgatgtttttgtggctagttacacataaattgccttaaatacatgtattcattttgttacttttaccacttttattatttattatatgctcagaaatttggtagagggaaaagctagtttaaaatttcatttttttatgtttaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctca

SEQ ID NO: 9201 - DNA, 2125 bp, Homo sapiens
tactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctggtgggtgtgcactatgagattggagaaatgaattaagttgacttgaaattattttacttttattaatcacaggtatctcaacctgcctttgtttcaccctacttcaagtacacttccacaccaggaaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaattgcccagtctcaggtattctgttatagcaaaaaaaaaaaagtggattgagatacttttttgctctgctacttacctcttttccagaatcttttaaggacttgatgtaggaactgagctatttagtaagtcattggtagaagtttccgcactgtactttgaaaattaagtgaaagcagaaaagtgagtgcgtatgtaaggaaaataatagtaaaagaacgctttgacttcttagcactcgccctctcctgtatatccccaggcaccttcagttgtctggaacaaagaatgtaggaaaaactgaagaaattcagaacagttaccaatgacaaaaatcactgatcagaataaaaagacaaggttacagaatatacgttgttactgatcatttttcagaagcagaaggaaaagaatgccctccctggccattgagggtgataaaaagtaagccccactcctatcacaggcaatgaaggacagggatggaaaaaaaaagtgaagaagaaggggaaaaagcaaaagttatgaaaaaaattagaaaaggg

SEQ ID NO: 9202 - DNA, 2123 bp, Homo sapiens
tactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgggtaaaattcttaattatctgacacatactggtcactcagtaaagggagcttttaccattggtataggtaaaatcccattacaaaaatacaaaaatatttttgtaacagttattttcctgccctcttggatgacctaaagtaatagtgttttatagatttcactaaattttcagtgtaatatcagatgttttctctggatgcagaaagaccatctttccataattaaagaacctggtgggtgtgcactatgagattggagaaatgaattaagttgacttgaaattattttacttttattaatcacaggtatctcaacctgcctttgtttcaccctacttcaagtacacttccacaccaggaaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaattgcccagtctcaggtattctgttatagcaaaaaaaaaaaagtggattgagatacttttttgctctgctacttacctcttttccagaatcttttaaggacttgatgtaggaactgagctatttagtaagtcattggtagaagtttccgcactgtactttgaaaattaagtgaaagcagaaaagtgagtgcgtatgtaaggaaaataatagtaaaagaacgctttgacttcttagcactcgccctctcctgtatatccccaggcaccttcagttgtctggaacaaagaatgtaggaaaaactgaagaaattcagaacagttaccaatgacaaaaatcactgatcagaataaaaagacaaggttacagaatatacgttgttactgatcatttttcagaagcagaaggaaaagaatgccctccctggccattgagggtgataaaaagtaagccccactcctatcacaggcaatgaaggacagggatggaaaaaaaaagtgaagaagaaggggaaaaagcaaaagttatgaaaaaaattagaaaaggg

SEQ ID NO: 9203 - DNA, 13608 bp, Homo sapiens
acttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtagaggcgcgtaatgccaggcactgtgtgccaaacgttttatgatgcttttagaactctcgtaacattcaggtgctgagggagtttgggggtagcggtgagctggtaaaaagcctgttggcaacgaagactgatactttgaaaatgctcgtttttatttttcccgtcttttagaatcctctttgccaagagtaaacattcgtctcccctctccctcacgcccctgcgatgtattgttttgatgcggatgtatgaacagttaatgtcaggggacgtactttaaaaaaaagtctaattgcaagttagatgtggttaaatgccctcaaaaaccacacatactggtagtttgaactttgttttatagaattaaatgcagccgggatcacaacactaaaaacctactatttgacacagtttgatccaatcttttttgaaaagtatagagattaacattatgctaatttttaaatacttgatttctagaccaggatgtaatcaataaaaacggatattaatatttagcaccaattatttaattatgctagttattttacattgactgcaagccacgtaaaacagttaggccgggcgcgctggctcacgcctgtaatcccagcactttgggaggccgaggcggacggatcaaaaggtcaggagtttgagaccagcctggccaatatggtgaagcccgtctctactaaaaatagaaaaattagccgggcgtggtagcaggctcctgtagtcccagccacttgggaggcagatgcaggagaatcgtttgaaccctggaggcggaggttgcagtgagctgagatcgggtccctaaactctagcctgggtgacagagcgagactccgtctcaaaaaaaagaaaacaccaaaaaaaaagaaaaacaatttgttattttttggaattaggtatgtacaaagtacttagaacagctggcatctaacaaagactaggtaagtactaaccaccattattgtgatgatgataatgatgaattttaaaaatgccatcccagagaaaaactagtcctttttttatgttgcccttatgcccttattgaaatactgaatttttttttttttttttttttttttttttttttttttttttttttagatggagtctagttctgtcgcccaggctggagcccagtggtgtgatctcagctcactgcaatctccacctcctggcttcaagcgattcttctgcttcagcctcccgagtaggtgggactacaggcacccaccaccatgcccggctaatttttgtatttctagtagagacagggtttccccatattggccaggctggtctcgaactcctgaccttgtgatccatctgccttggcctcccaaagtgctaggattacaggtgtgagccactgcgcctggtcagttttgtcttttttaaagatatgtttttgaatttagaatttaaaaaccctgactaaaatatatttacccattttgatcatatagctttgttactttatggaggaaaagtggacaaattaaaaaaaaaattttctttttttttttttgactcagggtctcattctgtcgcccaggctggagtgcagtggtgcagtctcggctcactgtaacctccgtctcccaggctcaagctattctcgtgcctcagccttccaaatagctgggattacaggtgtgtgccactgcacctggctaatttttgtagttttagtagaaatggggtttcaccatgttggccaagctggtctcgaattcctgacctcaggtaacccacccacctcagcctcccaaagttctgggattacaggcgtgagctatcacgcccggcctattaatacaaatggtcttaatttaaatgttatgatttttcaaacttacccactgtctcttaaactagtgacataatagccatgatttcattactgctgtctgctttgaatattttgaacaagaagccaggttgttattccatttttttctttctttctttaaaattttttgtaagatattataccatattccgtttcttaaggttggtacagaagtaattaggaaaatgaaatcactactttcagtgcttgggatgggacagagaggtgggcgcttctggaggcactagtatagccaggcctgtatccaaatttacaaggggcccggcacagtggcctgtaatcccagcactttggaaggctgagttgggcagaacacttgaggtcagaagttcgagaccagcctggccaacgtggtaaaaccccatctctactaaaaatgcaaaaattagccaggcgtggtggcacacgcctgtaatcccagctactcaggaggctgaggcaggaggattgcttgaacccaggaggcagaggcagcagtgaatggagattgcgccactgcactccatcctggacagcaaagtgagactatcgcaaagaaaaaaaaaaaaactgagttcaagaccagcccggccaccatggtgaaaaccagttcgttacttaaaaaatacaaaaattaactaggcatggtggtgcatggctataatcccaactactcgggaggctgaggcaggagaatcgtttgaacctgggaggcggtggttgtagtgagctgagatcaacccactgcactctagcctgtgtgacaaagcaagacaccgtctccaaaaaatacaaacaaacaacaacaacaaaaaaaccccacaaatttacggcaagaaactttacagatcttttgcattaaaaggttgatctctatcaaggggaaataggcaaaatgctgatgtgagtgtattccattctctgccctcttctccctccctgtcaaacaagagaatcatttgagtatatgctcctcttgctttttcttaagagcgggagcaggggacaggcaatgctgtggtgtcaggtggacctagatttaagtccccattattctacctagtctctatgtgactttggaaaaattaaaagtcagggaatcttggtggcaaaataaactggaatgtgattcttggtgagtgtcttcactgtcattctacaaggacagaccagactagatatttaatacatagtgagaatcttttcactgtgtcagaggcatatctggttttccatatgcatatgcctctgacacaatgaaaatttagcagtgaagtgtaaattgcccattgctagtctgacatggcagcccagaactccagtgcacagcatctaataatcctgaactcattggctataatgcaccattgtcatctacagacaataacgggttttttgtttttaaactgtagctgtgtcagcgtgttatgatgccgtcccgtaccaacctggctactggaatccccagtagtaaagtgaaatattcaaggctctccagcacagacgatggctacattgaccttcaggtaaatgcagaagagaactgacaagactgactggctgtgtttctgttaagttagcaggaagaccttccagatggagattttgctaactgtccttggggattagaaggagcaacaagaagaaaactcagctctgagaccctttcagccataatcgcagaagagggccgtggcagggtagtttcaaaccaattccagtattgtccatttctaagaatttttagttgtaatgcgagagccttgtagttacaggttttatttactttattcagaaactaatcagattgtgttttgttaagtggagttttttgttgttgtttctttttttaaggaactttaaaatttttgttaggtggaattttttttatcactgtttatttacactttagtcaaagcccgttcaccttttaagggagaaacttattactaaagccagcagattgtgggaatcttccttctttcctgatgtcatgagatccaatttattaaaggtattctttgtgataaatagtaagtaaaacacagtatttattaagtttgtatcctaccctaaccatttataaactagtcaatactacagcatctccttttgcacacttccccttacaatagaatgttctacgtggaactagggccaacgaggaagtagcaggaaaccatcctttataaataaataaattactctttggacccacatttgaaggagagataaaaatagatctggaaagatctgggaagcttccagccacttaggtcagatacaacgatgagccaaaccttggaaaatttgtctctgaatcttaaccttgaattgaatttgttcataaggcaggtttacttgctatgtggaacaaacaactaatcatttggaataagctgaaattgccttcttttccttttttttttttttttttggagacggagttttagtcttgtttcccaggctggagtgcagtggcacaacctcggctcactgcaacctctgcctcccaggttcaagcgattctcctgcctcagcctcccaagtagctgggattacgggcatgcgccaccacgcccagctaattttgtatttttagtagagacagtgtttctccatgttggtcaggctggtcttgaactcctgacctcaggtgatcatcctgcctcggcctcgcaaagtgctgggattataggcgtgagccaccttgcccagcctcttgttttgttttgttttgtttttaagatgtagtcttgctctgttgcccaggctggactgcagtggtgcaatcctggctcactgcaacctccccctcctggttcaagtgattcttgtacctcagcctccctagtagctgggggattacaggcatgcaccaccatgcctggccaattttcgtatttttagtatagatggggtttcgccatgttggccaggctggtctcgaactcttaacctccagtgattcacccacttcggcctcccaaagcgctggaattacaggcgtgagtcaccgcgcccagccttttttttttttttttgagacagggtcttgctcttttgcccaggcttgggtacagtggcacaatcaagactcactgtaaccttgaccttctgggctcaagtagtcttttcacctcagcctcctgaatagctgggaccacaagcatgtgccaccacacccagctaattttaaaattttttgtagagacaggatctcttaaatccccataagttagtacagccatctatgtgccaggcagttaataaatatatatctaacaaatgaatgactgtaaagtcatttctgtttttgttttaaagaaaagtttcttatgatacaatgaatgatttatggaatgagattcgaactagagtgaatgacattcctctgagattcctttgagtaactgtgagagcaataactagagcttcatctcttgccagtcccttttatttctcagagctgcactgggtggtaggacatacttaagacacataaagtatctagtttggttcttaattaccctcctgtttttgctgttgttgtatttgaaacaggctctggctctgtcacccaggctggagtgcagtggtgcaatctcagctcgctgcctcttcacctcctgggctcaagccatcctcccagcttagcgtcccaagtagccgggactgcaggcacatgccaccacgcccggctaatttttgtattttttgtagagacgaggtttcaccatgttgctcaggctggtctcaaactcctgaactcaagtgatccgcctgcctcagcctcccacattgctgggattacaggtgcgagctctcctccctgttttaaagtgtttgagactgggcttgatggcttatacctgtaatcccagcactttgggaggcagaggtggaaggactcccttgagcccaggagttggagaccaccctgggcaacatagtgagacctcgtctctacagaaaaatttaaaaattagctgggcatggtgacgtatacttgtagtcccagctacttgagaggatgaggcaagagaattgcttgagcccaggagttcgaggctgcaatgagctgtaattgcaccactgcactccagcctgggtgatagagcaagactccgtctctaaaatcataaaaattaggccgggcgcggtggctcacgcctgtaatgccagcactttgggaggccgaggcgggcggatcacctgaggtcaggagttcaagcccagccaggtcaacaaggtgaaaccctgtctctactaaaaataccaaaaaaattagctgggtgtagtggcgggcacctgtaaccccagctgctcaggaggctgagacaggagaatcacttgaatccaggaggcagaggttgcagtgagccaagatcacgccattgctctctagcctgggcaacaagaacgaaactccatctcaaaacaaacaaacaaaaacataaaaattacaaataattaattaaatgtttgaacccaggtatttgcattaatgttcttcgttgtctttttcatctctatttctcttccagtttaagaaaacccctcctaagatcccttataaggccatcgcacttgccactgtgctgtttttgattggcgcctttctcattattataggctccctcctgctgtcaggctacatcagcaaaggggtaagctgacgggcatgtgggaataagttgtgagatttttaaaatgttagccaaggctctagtgtgcgtgtgtgtgtgtgtgtgtgtgtgtgtgtgtgtgtgtgtgtgtttgtccgtcccagtggtctgttttttttgagacagggtcttgctctgtcatccaagctagagtgcagtggcacaacctttacctccctgggctcaagcgatcctctcacctcagcctcccgagtagctgggactacacgtgtgtgccaccacacccagctaattttattttttatttacttatttttgtttgttttattttgtgtagagacagggtttcactatgttgcccaggctgatctctaactcctgaggtcaagcagtctgcctgcctcagccttccaaagtgctgggattgcaggtgtgaaccattgcccctggccaattttttttccaatttttatgggtacatagtaggtgtatatacttaggggatacatgaggtattttgatacagccatgcattcataataatcacatcaggctaaatggggtatccatcccctcaagcattcatcatttgtattacattccaattatacttttatttatttatttattttgagacagagtcaggctggagtgcagtggcataatatcggctaactgcaacctccgcctcccaggttcatgctattcttgtgcctcagcctcccgagtagctggaattacagacgtgcgccaccgcacccggctaatgttggtatttttagtagagatggggtttcgccatgttgcccaggctggcctcccaaagtgttgggattacaggcatgaaccactgtgcctggcctatttttagttatatatatacatatacacatacatacatacatacatatatatatattttggagacagagtcttgttctgtcacccaggctggagtgcagtggcaggatctcagctcactgcaaactccggctcgtgggttcaagtgattctcctgcctcagcctcctgagttagctgggactatggtggcaagccagcacacttggcttatttttgtatttttagtagagatgggtttttgccatgttggccaggctggtcatgaactcctgacctcaagcggcctgcccgcgtgggcctcctaaagtgctgggattacaggcgtgagctaccacgtccagccttagttattatatttttaaatgtacaataaattattctctagtcactttgtgctatcaaatactagagcttattcattctatgtaactatattttgtacccgttaaccttccccattcccccctacctttcccagcctttggtaaccatcattctacaatatccatgagttcaattgttttaatttttagttcccgcaaatgagtgagaacatggaaagtgtgtctttctgtgcctggcttaatttcacttaacataacgttctccagtttcatccatgttgttgcaagtgacaggatctcattctttttagtggctgaatagtactccattgcatatatgtaccatattttctttattcacttgtctgttgaagaacactttggttgcttccagatcttggctgttgtgaatagtgctgtcataaatatggaagtgcagatacctctttgataaactgatttcctttcttttgggtatatacctagctgtgattgctggatcatatggtagttctatttcatactgttctccatagtggctatactaatttacattcccatcaacattgtacgagggttcccttttctccacgtcctcgctagcattcgttattgccgttttttttggataaaagccattttggctgggtgcagtggctcacgcctgtagtcccagcacttttggaggccgaggcaggaggatcacttgagcccaggagttcgagaccagcctgcgcaacatagcgagaccttgtgtctatattttttaaaaagccattttaactaggatgagatgatatctcattgtagtcttgatttgcatttctttgatcaatgatgttaagcaccttttcatatacctatttgccatttgtatgtcttcttttgagaaatgcccatttttgattggattattagattttttttcctacagagtttgagctccttatatattctggttattaattccttgtcagatggatactttgcatatattttttcccattctgtgggttgtctcttcctttgctgtacagaagctttttaaccggatgtgatctcatttatctgtttttgttttggttgcttgtgcttttgggggcattactcaagaaatctttgcccagtccagcatcctggagagtttcccccatgttttcttatagtagtttcatagttttaggtcttacatttaagtgtttaatccattctcatttgatttttgtatatgtcaagagatttgaggggtctagtttcattcttcagcatatggatatccagttttcctaataccatttattgaaaagactggttctttccccagtgtatgtttttttgttttttggtttttttgtttgtttttttttttttgagacagaatctcactgtgtcatccaggctggagtgcagtggcaccatctcggctcactgcaacctcagcctcccaaataactgggaccacaggcatgtgccaccacacttggttaatttttttttcattttttgtatagatgaggttttgccgtgttgcccaggctgatctcgaactcctagactcaagcagtccaggagtacagtggtgtgatcacagctctctgcaacctcaatcttcagggctcagtcgatcctcccacctcagcttcccaagtagctggagttacaggtgtgagtcaccatacctagctaatttttttgtttgtttggtagagatgagatctcattatgttgcccaggctggtcttaaactcctaggctcaagcaatcctcctgcctcagcctcccaaagtgctggaattacaggctttagccactgcacccctctgactatgtttcccgttgtgtgttaattatggtcagtgtgaggcccaccctagcctcccaaagtactgggattacaggcgtgagccaccacacccggtggatgtagaattttatcaaatgcttttctagcatcgattgaaataatcatatggtttttgtccttcattctgctgatacgattttatcacattgattggtttgtataagttgaaccatccttgcctctctgggataaatcccacttggtcctgatgaatgatctttttaatgtattgttgaattcagtttgctagtattatcctccttattgaggatttttgcatcaatgttcatcagggatattggcctatttttgttttttcgatgtgtctttgcctagttttggtatcagggtaaaactggcctagtagaatcagtttggaagtattctctccatgtctgttcagaatagtttcagtaggattagtattctttttttttttttttttttttgagacagggtctcatctgtcatgcaggtgtagtgcagtggtgcgatctcagctcactgcaacctttgcctccccggcttatgtgatcctgccacctcagcctcactagcaactgggaccacaggcatataccaccatgcccatctaatttttgtattttttgtcaagacaggattttaccatgttgaccaggctggtcttgaaatcctgagctcaagcgatctgcctgccttggcctcccaaagtgctgggattacaggagtgaaccaccatgcccagccaagtattaattctttaactggtataattcagcagcgaaaccatctagtcccaggcttctctctgctaagagactttttattatggccttaatctcattactctttgtctattcaggttttagatttttttcattgttcaatctttgtttttatattcatgtctggtacagcagattccagcagaaaaaccaaaaagattttcttttacattttgttctctgttggcaaaacatgtttttcttcctttgagcaacagtaaacttccatagttcctataggggaggtggtggcaggtaggcaaacttggcctctgagatattagacagtttgccctgtcatagtttggaacaacatggctgagcctggcatacaggagtcctgattggtaaagggctgtagctggagcagcatgctgtcattgtagctgtgcagtgccatggacatactgtcagtatttggagagaaatagcaattctgttatatgtgtggggtcactgtgcctcgtaagtcagttccttcttacagtaggtttggttggagttcctgttgagcttcaatatgaaaccttagaaacctaaagtagttggtggttctttctcatgggctgtccccacatacacagtgtccaagttgtcttgaaccaattctgactataattaacacacaacagggaacacagccagccaggtgcagtggctcaagcctataattctagcattttgggaggctgaggcaggaggattgcttgagccccagagttcgagaccagcctgggcaacatagcgagacctcatctctaccaaacaaacaaatgtacaaaatgagccaggtatggtgactgacacctgtaactccagctacttggaggctgaggtgggaggatcacttgagcctgggaagtcgaggttgcagtgagctgtaatcacaccactgtactccagcccgagcaacagagcaagactcttacctcaaaaaaaaagaaaaaagagaaagaaaagaaaacctgaaaggctgagaaaaacacagagtttattgtagtggtatctgtacaattacaaaaggtgaaaaacaaccaaagtgtccagcagctgtatgtggggcagttaggtaaaactgtagtatgtccatttcggtggaatgttacacatccttacagtttaaatgtatgaaaaggttttaataatattggccacaggacacagagtatggtgtgttcacaactaagagctttaaaaaaaggaaaagaagccaaaatatctggatgagaatgggtcatttttttctttataattgttaatattttgtagtttgtcttcaatttataatcaggaggaaaccttttcccttggtggtatacaactcaaagaaaaagtactgaagagtataaaatactgatctaaggattaggtctgtgacgttttattttaaaatgtgtaactcttacggtactaatgtgtttgcctccttctgccaccagggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaacattttaatgattttatgatatctttaatcccagtacctagatctaccttagtttctaggtagctggcattgtgggtcacactcaactttccctaactctgaggttatggacttgggcaactggaagcctggacatgccatcagctgagttgcaaggctgtgggaagagcaagttttagatgtctactcaatatccaagtggagctgttgaggaggcagttgcgatgcatgtgtgtgtctagagtttaagagtgggtcttggatggaaatagaaatttgggagtcagcatttggacagtatcttaaaagctagagggctgtttgagatcaccagtagagtgagtatagttggagg

SEQ ID NO: 9204 - DNA, 244 bp, Homo sapiens
ttacttggactgagttctagttactggacatgagaattaaccatgtccagtagtaagttcattttcctacagtgtgcctgtgagtggagaaggaaataggctgcaaaagagcccgatggaactttggggtgatggatatatttccatctagattggtgatggttctaggaccgtatgtattttcagagctcatctatttgtacttgtgtataaatacttcaataaacctaactttttaaaaagc

SEQ ID NO: 9205 - DNA, 945 bp, Homo sapiens
cagctggcattgttacagaagtatcatttatgaagccaaaatcagactccctgcaacttctgtgttttgaccatagttgtattatttggtgttttatagaaaagacctaaacctctacggccatactaccctgaatgctcccgacctcatctgatcttggaagctaatccgggtcaggcctggttagtactcggacgggagaaaagatctaaacctccataataatgttgaacatttcttgacccctttgccagatattctgccaaatactttcattacatatctcattttaatccttagaaaaatcctgagttagccgggcacagtggctcatgcctgtaatccccgcactttgggagcccgaggcgggcggatcacctgagtttgggagtttgaccgtcctgaccaacatggagaaaccccatctctactaaaaatacaaaattagttgggcgtggtgacacatgcctgtaatcccagctacttgggaggctaaggcaggagaattgcttgaacccggcaggctaaggttgcggtgagccaagatcgcaccactgcactccagcctgggcaacaaagccagactccgtctcaaaaaaaaaaaaaaaaaaaaaaaaaatcctgagttagataagattcttaggtaggaagtaggtgagatatttgggattaaagcctgggcctggtacggtggctcacgcctgtaatcccagcacttgggaggccgaggtgggtggatcacttgaggtcaggagttcaagatcagcctggcctaaaaatacaaaaattagctgggtgtggtggcgggcacctatatcccagctactcaggaggctgaggcaggagaatcacttgaacccgggaggtggaggttgcaatgagcctagatcacaccactgcactccagatggtgacagagtgagactccgtctcaaaaaaataata

SEQ ID NO: 9206 - DNA, 4997 bp, Homo sapiens
agcaggcaggagaaaataaccagaggaatgtggattgcttgcagctaaccgggacctgttcatctggttagtttcttttctcccatgctcttgaggaaaggtattactcttggattccagttggccaagaggaaggttcaagctttttttttttttttttttgagatggagttttgctcttgttgcccaggctgccgtgcagtggctcaaaccagcgaaggctcactacaacctccgcctcacaggttcaagcgattctcctgcctcctgagtagctgggattacaggtgcacaccaccatgcccggctaatttttttgtatttttaatagagacggggtttcaccatgttggctaggctggtctcgaactcctgacctcaggtgatctgctcgccttggcctctcaaagtgctgggattacagacgtgagccaccgtgcctggccgaaggttcaagcttttaaatccaaatagaatctagtgattagattgatgcagaaatttaaactgtacttgggcatcacttgcttccattggctcaccagtgattgtagctgatacagttatgtgacaaaagattcattcatttagcaaacaaatcagaggtgcttattgtgtgtcaggcaccagacattgatttttctttttagacattgattttatattaactattagtttccatgttactttaccttgaattgggtcagtagatgagaaattttcctggggagacacactcttcagaaaaggtctaatttagggaggtgttttgaataagattaatttcccaaatttcaacaaaactttgtccaagaacatcatacaaagtgtctaccctacgcttttattccaatcatcaaatcctttagagagattccaaggattatgtttcactgagactgattttatttgctaatgccaattttgggattcaatcagtttaaattagaaatctggaagggcccttcaggattggagactagattggtttctagctagacactcccacctttgcagtttcagggtaaactttctttcccaagaaataaaagcatgtattaagaatgctgcttctgccaagactctgtgtagacccagccaccattgccagatagtctgaaaaagtataaaaaaattagccgcccctcagtgtgtggtcatgaagcagggccaggggcactctttaggtatacagcataaagtatgtcatagatagtaaatactggagtttagaatccatttgtaaagaactgtcagcttgagtgtattaaggcacaaaagcaacttctgaaacacaggcttgatatttgttgctggggctctgaatcattttggagtaccaggacacttagcaataggtgggattattttttcagggaaaataatggtgttccattcttagggtcatagatgactagaaaaagaaaggtccaaggcttagaagaaagatcagctatagattggaaataagctgaaagccagatatccctctcacagattggcacagctccatgtagaaggtctgcccagtgtgttgaggtggggcgagaagttggcattgctgacattgcgcttctccttgctgtaatttcagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaaggtaatgattcctcaacctatcactctgtgggcagctgcacctgtatttctttacagtttgcagaagaaagcacatcagttttggtgggaaattctgttaccttgttttaccactagagggtgctccctccatgtttttggtacctaacgaggcaccctcttggacaggaagcagattcactgggattttactaatccctggggcttccctagaaaaagatgtctccatgtggcctgtttttgggctttcctgggagcctcctttgtcgtagatttgatctgtcctgaaagtttagcagattcatttttcttcaaagaggtgaagatggattctgactttttttttcccccttatgatttgcaggaattgacacttaaatatattgcctttcttattggaatgaagctagttgggataggaatgaaaggttaaatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgttgggaattgttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 9207 - DNA, 1170 bp, Homo sapiens
ctcccagagtgctgggattacaggtgtgagccactgcacctggccacataatttttactatatgcaagttacttttctcagtaatttataatttttagctcttaattcccacagaagtcctttgagacactattattatccccagtttacatgtgaggaaactgaggttctgagaagttaaataacttgcctgaaatccaagtaactagcaaatgatggagccaggatttgaccttagtcattcctgctttggagtctgtcctcttaatacattatatggcgtctctaatttgtgagtgagtgaataagtgttttgagattttaagtatttataccacttgtactccacttttgctggagggtggattctaggcaggagtctgggatgcattgaggatgttaatgaatttagcaaatactcactgagcacctgctttatgtcagggatatgaaagtgcttgacagacaaggttcctgccttcaaagagcatatgttccaggggggaatctgacagtaaacaagtaaacaaacagacatggtaatttcagattatcagtgctatggagaaagttaactgttacagtacattgcagagatgggttctgtaggcagtgtgtcacacaatgtttaatgtcatatagctttcatgatgttggatattatctccccctttttttttcttttcctttttttttttttttagacaggctctggctctgtcaaccaggctggagtgcagtggtgcaacctcagcttactacaaactctgcctctctggctcaaggtatccacttcagactccctagtagctgggactgcaggcacacaccaccacacctggttaatttttttccatattttgtagagacagggtctcactttgttgtccaggctggtcttgaattcctgagctcaagcaatctgcccaccttggcttcccaaagtgctggaattacaggtgtgagccactgtgcttggctcccaattttttttctaattaaccccacatctgctgaattaaaggagagtgttaaatacaaaaatgaatttattatgcaaatctgcagttatcgtgtatgttcttttggacttgtaataagggagtatgttctagtattgaagaaatagaaccagagaggaatactgctgtaaaaattaaaaaaaaaaaa

SEQ ID NO: 9208 - DNA, 88 bp, Homo sapiens
ttttttttttttttgagacagagccttactctgtcacccaggctggagtgcagtggcgtgatcttggctcactgtaacctccgcctcc

SEQ ID NO: 9209 - DNA, 1203 bp, Homo sapiens
aacattctagcaggggtaagtgaccatagctgaattcttttcttatcaatcaggaaaatgaaaatccttccttaatcaatttctccaaagtctctgacacataacaacaactccaaaaatgcacctctctttccatcaaactccactgatatgaaaaatgggcaacctgtttttccttgccctgttagtgaacttgtgggtgtacccagtggccactctaaggatctctataatcaacaagacacagtaacaagtgttggcaagcaagtggagaaatcagaacactcacacattgccagtggggatgtaaagtggaaaacagtttggaagttcctcgaaaagttaaacatggaattaacatacaactcagtaattccacttactcctaggtaatatccaaaagaactgaaaacgtatgttaacacaaaaacctgtacacaaatgttcacagggcattattcataatagccaaaaagtggaagcaacccaaatgtccaccatctgatgaataaatgagttatatctatataatactattcagccacaaaaatgaaattctgatacatgctacaatgcaaatgaagctttaaaatattatgttttgaggttgggcatggtggctcatgcctgtaatcccagcactttgggaggctgaggcaggcagatcacttgaggtcacaagtttgagaccagtgtggccaacatggcaaaaccctgtctctgctaaaaacacaaaaattagtcaggtgtggtggcgcacacctgtagtaccagctactcgtgaagctgaggcaggagcattgcttgaacagggaaggtggaggttgcagtgagccaagatcttaccactccactccagcctgggcaccacagtgagactccatccccgccccctacccaaaaaaaagtatatgtgtatatatgttttgaagttagatgtgatttaaaaattagaaaaacaaaatatgtatattaagtgaaaaaagctggcaaaaaccacatattgtatgattccttttataatgaaatgtccacaatccacagagacacaaagtaaaatggtgcttggtaagggctggagggaacaaggaaaggagagtgactactaacaggtatggattttgtgctggttttctgaagggatggaaatgttctaaaactagaaatggacaacgtctggggatattgcgatgactactggaa

SEQ ID NO: 9210 - DNA, 1252 bp, Homo sapiens
aacattctagcaggggtaagtgaccatagctgaattcttttcttatcaatcaggaaaatgaaaatccttccttaatcaatttctccaaagtctctgacacataacaacaactccaaaaatgcacctctctttccatcaaactccactgatatgaaaaatgggcaacctgtttttccttgccctgttagtgaacttgtgggtgtacccagtggccactctaaggatctctataatcaacaagacacagtaacaagtgttggcaagcaagtggagaaatcagaacactcacacattgccagtggggatgtaaagtggaaaatagtttggaagttcctcgaaaagttaaacatggaattaacatacaactcagtaattccacttactcctaggtaatatccaaaagaactgaaaacgtatgttaacacaaaaacctgtacacaaatgttcacagggcattattcataatagccaaaaagtggaagcaacccaaatgtccaccatctgatgaataaatgagttatatctatataatactattcagccacaaaaatgaaattctgatacatgctacaatgcaaatgaagctttaaaatattatgttttgaggttgggcatggtggctcatgcctgtaatcccagcactttgggaggctgaggcaggcagatcacttgaggtcacaagtttgagaccagtgtggccaacatggcaaaaccctgtctctgctaaaaatacaaaaattagtcaggtgtggtggcgcacacctgtagtaccagctactcgtgaagctgaggcaggagcattgcttgaacagggaaggtggaggttgcagtgagccaagatcttaccactccactccagcctgggcaccacagtgagactccatccccgccccctacccaaaaaaaagtatatgtgtatatatgttttgaagttagatgtgatttaaaaattagaaaaacaaaatatgtatattaagtgaaaaaagctggcaaaaaccacatattgtatgattccttttataatgaaatgtccagaatccacagagacagaaagtaggatggtgcttggtaagggctggagggaagagggaaaggagagtgactactaacaggtatggatttgtgctgtttttctgaggtgatgaaatgttctagaactagaattgcacaactctgtggatattccaataactactgaaaggggggactttaaggcatgtcaattatacttcaataaatatgttaagttcaa

SEQ ID NO: 9211 - DNA, 99 bp, Homo sapiens
agagacggggtttcaccatgttggccaggctggtctcgaactcctgacctcaggtgatccacctgccttggcctcccaaagtgctgagattacaggtgt

SEQ ID NO: 9212 - DNA, 414 bp, Homo sapiens
tgagtatgtcaatacaaatttatcatactgaccaagttttattaatggtgggcaaatggcatcaatcctatataggagaaataattgtataccttcacagacaaaaataatttccaaggagtgtggagataagaggaatactttctcttttcactcaatttctttgagccttggtttccttatcttgaaaatacaaaaaacaacctcctaaagttgcaacctttgcaatcacaagagcccatgagaggtggccaccccagagtgattcccagctctgtggtcagtgggccagtgaagggaggatgatctacacaagtgcctagaacagtcaatgaaatgtattttcatttaatagtcataaataatcctgtaactgtgtagttcatggtagtaggtaacttactacatgccttc

SEQ ID NO: 9213 - DNA, 99 bp, Homo sapiens; identical to SEQ ID NO: 9211

SEQ ID NO: 9214 - DNA, 34910 bp, Homo sapiens
gcagacggcggagagcagagagggagcgcgccttggctcgctggccttggcggcggctcctcaggagagctggggcgcccacgagaggatccctcacccggtgagtggttggccatccttgccgcaaaggatgtgcaaaaggaagacggcatccgcttctgggatgggctctgtcctcctggacatgccgagagcctgcctgatcctgggtcctgctgctggaggcggccacttcgcctggtccccgagcgtccgcaacaaaatttgtcagaaagaaaatcttgaggcacatttccctggggggaagtcagggctcctctctggagggtccagtccttaagggtgggctgggtggtagggacttcagttcagaggagcgggaggaatcagatggaactcctcttggattcgggtatacggcagtcactggggggcgaaccccggatttcctgtattagaagccgcctctagaatcgcgttaatagtgggagatatggcggcgatgccttctgcgtgccccatgaattagggggggaagcacccgaatagaagggtctcccgggcatatttgcctcgccagctgttggccaggtttttggtggatcgtgggcgggaggagtggaggttcctcttcgcgaggttttccgaatccaaatacacaggtttagtgcagtgtggaccccaggcaaaatgtggagtaaaatttctacccgatatcatctggttctgccctgatcagccactttcacagtggagagagatggcgcccaagtgcaaacctgccagtagccccctaggatcagtccttgccgaaggggggtcgtgggattgggggcactgggagaatagatgcagggggtgggttggggaggagagaaggccgtgtccttgggtctgggaagagggaggagagaaatgcagaaaaaggggtgtgttgctggggtctggacgctgggagctggggatggggtgccacgggggtcttcagagcgttgcgtggaggtcgctcgaaaatcctgacatgttgcagtcttggacttttggtcaaatcgccttttgccatttcctttgtcagagtcaagcccccccaggccgccccctcccaccctgggccggcgggcctggtgggggcgcaggcgggtggctacgtggcaggtttctggaaggtttcctggctggccgcgagagggcgctggcggcactgcggaattttggggggcggggtggggaggggaggtggcctttgttctcctgatggagggggtcgggcgcgggatctactggaggatcctggattcgtttacccaagagggaacagttttgagaccccccggattcactgcggagtggccgcagaggccggggtcggcctttgcgccgtggcttcgggtgttgtggaggcgcacagaggcacgttagttgatttccagtggtttttggtttcgggggtcttaggaaggtgtggctcatttgagcaggatggagagagaggctgtgacaaggtcagtgaggggccatcgtgcgggggctagaaattgttgttgtggcgaaggagggaggcacgactttggaggcgtgatgttgatgcctgggggcgaaggcggggagcggcgtggtggccccctttgcgttactttccagcgatgtcacaggttctgtctctcgttccgagaccacccacatgcgtgacagcggtgcctggaggactgggtctttctgactttagtgaacgtgtgtttaattggattgacgaaggtgggagtcgggatttctgcttttccctgtagcaggcggagcggcgctccagaggggcctggcgcaggtccgctgggtggcccaccttcctctggggctggggcccggtggctgggggcgcaggaggcgcctggtgcgggcgggaggcgctgcgccgcagccacaggtgggctctggctggtggtggctggagaggcgtccagggggcgtacgacctggcgcggtggcctggggtgggctgtggagcccttcctagcctgagacctgttgggcaccccctgtccatccaggcccgccgggcgcgggccgggggcgccgcaggtggctgctgcactcctgggttacgggtgcgggccgcgcgccccctagcggtgtgtgccagccccgctaccttgggttttgagttgcgcacacgcacacagctaacacttgtgacctgtcagtcaaatcatccttaccccctcccactcctctcctccacctcccatttctcctctccctccaccctttctcatttcctcgtccctcctccccctcctatttttcttctccctcctccctctttcctcttccctcctccctcttcccccctcattttcctcatctctcttttcccctccccttctctcctcccctctccctgcccccctccttcctccctccatacccctccctcttccctcccagcccctccctactgccttcctcagtcctcccctttgccactcctccctgcctttccctctgcctgcccccttttgctctctgctgttccggtgctggccgttagaggtcacgaagatggtttctaacctgcccccctcccatgccatagggtctctcctcagggatgacatcatccgtccacctccttgtcttcaaggaccacctcctctccatgctgagctgctgccaaggggcctgctgcccatctacacctcacggtacttcaaccctcctgctatcatttcataaccaacgtggcgggcagaatctcccaaccccaccaccatccttgcaccacccccagacccactagcaattaaaagacaattttaaattttaactaatcagctttaattgtaattaatgaacttaaactgtaattatgatctaggcttgggcttttaagcaggttctctaacctttgatcaattgcagagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgttactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcttcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggtgggtgttgcccccgcctgcctttgcctccgccgtggccctgagagtcctgggctctgccccgcccggtcccttgctccccactcagttctggatttggggctgcccctaacccagcccgttgctgctttgcaccttttcctgtcattgggcatcccccagtagtcaccccactccaccgaaaagtaaactgcaggtgaggccgtgccccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttggggtgagtttcttgctttcttgagacccaggattttattagggtcagctcatgtctctcctctctgatcaacaagagtgtcaacatttaatttggggaggaggcaccctgccaaggtgaattctcttcacatcagccccaggggtctgggggccggagagctgcctggagtggagacccttgctatacccagcaagcatgtgtgggggtccaccctggctgatggcatgctgtgggccggcgacggtaggtggggagtgtccacctccactctagacccccgagagcggctcgggccaggcactcaggagccctcagtacggctttgctgaacacattgcaaaagggatccagggggcacttgccctgcccacacccggcccagggaccccttcggagaggaggaaatgggaatgcttgcctgctcctcagctaggaagacatttctttccaccagccatggtagcgtcaccccctgtgagaaccgtggtttctcacacatgaggctttgataatgtcctttaatcaaatagtggtttttgagcaagttcttctctttcctcctttcctcacccctgaaattgcaatgagacgggaatgtttttgtttgtttaaataaaacagcaatggtagagaagaagaaagcgggattggagccacacaattcactcgaggacccatcatttgtttatttgtgttttactaattcaagatgcagccgggagccgtccagggctcgggcctggggttgttctggggcgcctaaggctgggctttgcactaaggaccagagggtctacttgggtgccgtggagcacccatgcagcaaggtggcttgcacagcagccaggcgaggtgtcgtcgagggcgggggctcagggtggcatgctggacggccatgccaggctgaagtttgggctggcaggaagagaggaggctcagctgaggccactttcctttctgggggtcccagggactgagtctgtggctcactcagggcgatggggtgtttttagagccactgccctgggaggcagtgtcaggatcctggcacccctcatatatgacgcccctggggtggccattgtggtgaatgagtgcagttagacttcccagagaagctgggtgggcgctgagaaaggtctgaaccgtggggtgaggctggctccattcccccagacatttatggaggcttgagggggccctagcactgtccttggcccagatgccaatactcccctctggacgcccacgaatggggtctctgagaaggaagtggatgaacacagctgcacgctgggtggggcccagcctctagtcctcagccatgtgcacgcatcagcccttgtgcaggcctccgccctccgccaccccccacccccggagtgtctctggtttccgacgcagcctcgtaatgctctttaatcaaacagaggatttggagacagctctcctgcagccctgcacttctcccctgaaattgaaatgggatggggatattatttttaaacaaaatctggcagcgtaggcagagggggcagaggcgctctaacctggggctgttgcctttgtctgcttgtttctgctctctggagagccccagagcctggagagacggggaggggagtgtgtgcccagggctaaacccagggagggggcccaggaaggctctgccccgtgacatttactccaaggctagcatttgctgagccacctgcaaacacagtgatgtggagaagaggcccgggaggggaggtttgcacaggggcaggctgctggggtcctggggggatcctgtcccaagcttactagaatgcattcgagtaactggtctgagccagatgccctcagctcttggactggtttctcacggacatctcaggactttcccaaggtggactaagcccagggacaaagtcaaagtgaaggccaggggcacacaggagaggcccagataggaccaagctttggcagcccctggctctcaggggttgaaatggaaccctctttgcactgagttgtatttcaggtactcatgagtgtttcggtctcaggcaaacacatatttggggttttgtgtgtcattaggtataaaataggtaaaatatgccacgttctcaatgaaagaagttgaaacgtgacttactacgtcagccttgctggtgatcttctcgggaactgccgaaaggccactagtaagtgctgaaagacatgatcattttcaggaaaattctattttgatggattggccaatgcctgagccatagcgggtggagatgagaccctgactgactaggcagtgagccacagaggaccctgtcacatcagcggagggcggtgaggggtctctggccatttgtcatcgtgctgattcctagggggctgcctctagtgggactcttctgggtgggtgcaagtgtcagggtaaagacggcggtctggtctggaaactggctctcctctcgcacctgcccgccctgggtggttgggaaaggaaaccaagagggtagctcaggcctgagctcgtggaaaggaagaacatgacccctcattcgctcactcgcccccacattctctcacctgcgagttgctcattgctgctttcagggcccctgacctcatgcctcctgagttgtgattcaaaccccaaatgaatttccaagtacatttctccaaataatgtcaaaacctggcaagacttaagggcaacaggatgcatgtgtttcttattcattcatttacataaaataacttaagtgtgttttttatgagcaatctgacttccaaaaagaatgaaaaggaaaatctacccatctttaatgaacttgctaatgaatttttccttgcaaagaggaagggagcttcctacagaagggggtgtggagggagacagattcaggtcccaaagggttaaagggcagtggacaatgcggaagccagcattgtgagctgcagtggaaaagccctgggtcgctgggagtggcttctttttaggagactggaattaatgagttgtgaagtgtcccaaggactggttccccctccctgctgtttctctgagccctgtcccctcttccaaaggaggaataaggaggtctagcttcgtctcccatccccgatttgagcagatggaagagtctagaaaagaggtgtaccttttgaaacgaggcctcagatgtggggttcctggtctggaaaggggaaggatgaatctggggtaggagagggtctcgtatggagccccattcagacagggcagtcccacacctgggctgcccacaggttcttgggggagtctaaggaaaggggagccacagaacaggcttgcctccttggcatggattgggtcagtgtttcagagccaggaaaggtgggagtgtggggggccctcggggctgatgagggcgtgcagaccctcccctcccacctcctgtcccaggagccctgcagacactgcagcaggagggcactctgccagaagaggggttccagctccagccggatccagcagacatggagagaccccttatctttgccaagacgagctctgcggtgcctgagaggcccgtaggtctggaattctagggccttctgggtttgagtcaggtcctgaggccagggcctgggccctgatcctcaccatggaaaactggtcactttactcaggataaactgtgatgaggacttgggacatatctctgtctgtcctctcagctcgcgtcacccctgagcccttggcgatcgtgggcggcccgtgtacagagcaggtgctgggtcactggggccgccgtgggcctcccaacatgagggactgtgtgtgagagaggagttcattaagggagaggatggtggtgaagggtgtagccatgactttcttaactgctctccaatttctttgagcttaaaaataaatccagatggagagttcttaagtcccctatcctgggagaaaggaaggctgcccaccaccttcggcttgcctcgactctgagcagtgaatagggtctttggcaggggcttaaggaggagactcttagcctgggagctcccagggctgtttcagatggaaacaaaggctcaggccgagaggaatgtgggggagccccccgtggggaacagccacctggggataattgggagggctgagcgcagatgagttttcccaggttctgtgaatgcgccctttcaatggaaggtgcctttttttccagatgaaaagaagaaaacgtcaattaccttcccctgaaacggagtgtgtgtgtgttccctcccaggggttgtgtggggccccttgcccttgtgtgtgtgtcgggagctccaaggctgcacaatgacgcacttaaccagccactgggttcgcgcgaccctgggatgctcacgctcttagattctagggcttgattttgaaagtttcttagcaaaggggaatcagagtgattgagcctgtaaacaaaaatttgatcaacctgggcctgatgcctgaaatatagccaaagagacagaatggggctgcggggagagaggtccaggatggaaagttggggaaggaggacagtcgggggccaaaggctgaccgcatgtctgcgccggcctccgcgctcacagctgggctgctccttctgccaccccagccctttctctgggccttcctggcagtggacatagagtgattccctactcaggaagttggcggtagggggctcagaaatccacagggctgttgtttcacagttagccaggagaggagggggtcatggtggcccgcagggatggtgggcagctgcgagagaggggacgcttcaggttagagcgaagctgtttgcaccaccactgccccagactgccgtaagggtagggccactccagaggcaccagggacaaagtccctgccgtgacaggaggggggcacaggtctcagtcttggctggtcactgactttgctgctgctggcttctgagcctcagagaggtcagcagtcttccagagacctggttagagcctgtgctcagccctgactatgggtgtgaccttggcccctgtctccagccccttaggcctcagttttcccgtctacgaaatgggcgagtgcaggcccatggtcgtccgagtggctcggggtttcttcaggcctccctggaggtcatctgtcgtttgtttgctgggtctttggagttgttgggactttgggggtcactggtccgctgccccctctgctttagaggtggggaaaccagcgatcccagaggcccggagccttgcccgaggttgcacggtgagccggcagcaggccctggaggtgaagcccctgccagttgccagctcctgtgtgacctgtgtggtcggggggggtcacagtcaccggtcattagtgtgggtcagagctcttgcccaaagaaggttccaaggggctgccccatgagctgggatgcagggatcgtgttttatggggcattattccaaacaggcaggctgctggtctggtctggaacacctttttggtctgtagagtgactcttgtttaatgagactggacttgtggcttcagaaccaggagatgttcgttcccccaacccccgtggctcaccttgtgccttttgggtcctgagaccctcgccagcgcctctgttggcacggtggcccagtcggctgagaacttcctgaaaaagccaacaggatgacaacttctggaaaagtgatcatcacccgcctgcactggctgcccatcttagactcagctttgccaacattcccagctatctctgtgtgctgcagtgtgtagtaatgaacagctcacaaaacctccggctgggcctgcacctggttattaccgtggtgggctgcagcttttgttttgtgaccttggttgctacaatacctgcgagctgaaatgaggaatcgaaaaattgccagcttcaattagacgggcagactgctttcccaaggctgcctccgccactccatccattaacggtaaacaggcaccaaataggccctaattctctctaattgcccactcctgaagcaaagaggtgaaattccaggaagaggcgtatgtaaacatcctctgtaacctgaccaagtaaaattagagggctgatgggggcctgcgagagagaggggacatgatttcaaaagatgtcccaattacctctcctattttcataaatgggtctgtaatgtccagggccccggcctcacaaaggtacaggaaattagctctgcaaagagcttgcatttgtcaggggaagttgtaagggggtggtgtttactcaacaggtaggaagtacgagatctgaggcaagactgattatttgtgtaacgacgggctctatttcttgagatcaacattttaataaaagtcatccttttaggtccttttgtgtttgaaacagccataagttgtttataccaaagacatgccagatcagttaggtgctgtttgcctccagaaaagaggaacttttaaaatcctaagatgcagagctagagttttctaatcccattaagctgtggaagatgtttttggagtgttcaccaatgctttctgcgtgggtcatgagctcactgcacgcacttatgaggtcttccatcaaatgcttgtgacaattactcctctggactctataaggaggcctcgtgtttttctttggttccagacagtgactcatctctgcagcttttctgacatttgttaagattctagcccagcactgcgttattaacacatcacagcaagcccagagctggcacacgcagcttttaaaccaaggcacgaatttgctggggcttctctgtagcagagcagcctgcggtctgcacacaagagttaattaaggacggtcagggactctgaggtttcatggggtccctggagcagaagcaggaaaaaacccagatgctccttcctgcttctgatttctccgctcctattaaaaacacaaaaaagaacaaaacaaaaacagccaaacaaagcacccgcctctgattcctgcgggaaatggcagtgcctttggtcgcgctgtgtgttcttggcctgagtctcgttgccaccttaggacgtggcgatggtgagaggccaccccagccacgcacagtctcggagggagggtgggaaacggtctcgagtggtggtcagtagataatgggtggtctggcagcctttaggtaaccgaagtcggcccctcagtcacccatgcactgatcattgcttcactaacacttattttaagacttgttgtttcttggttatcaaattaaccagttatggcagaacagggtttatgaagggcaaggccagggaaggagattttaggaagatttggaggcaagaagtgtccccagtgccctggccgggtcttggacatcctggctggagacatgactaggaatagagaggcagaggcagcaggggtggcccagatggcaggggtgggttggagagatccctgagaggcctgaggacaggcggcagtcttgggagcccctgaagacctgcagtggggcaggcagctggagtcaggtgtctcccgggacctgttttttttttttttttttttttttgagacagagtcttgttctgttgtccaggctggagggtagtggcgcaatcttggctcactgtaatctctgcctcccacgttcaagcgattctcctgtctcagcctcccgagtagctgagaccataggcacataccaccacgctgagctagtttttagtagagacggggtttcatcatgttggtcaggctggtctcgaactcctgacctcaggcgatccacctgcctcagcctcccaaagcgctgggatgacaggcatgagccacccccctggggctggtacctgtggtctgtggcttctgcctgccctggtgcccccacatctctctcatggcctttctgtttcctgggtggctttgtgggggtgtcccatggtctccccctggcttcctgtctccacctgtgcctaatccaggaaacggtccccagagatggtgttttcaaacagaccttggccctgtcctcctggcccagcccctggctgccctatcacctagcttgctgcgttggtgggacctcagctgtcacaggctacctttctatgacgcctcctcaccttaagtagactctgaacagattttaaaagccattcattcaacacattttttaaatgaataaactttttttctgtgtagttttcagtttacagaaacattggtgggaaagtacagagaattcccagatcccgtccccaccatctcccctgtcattcacacgttgcctccgtgtggtgtggtctgtttgttccgatcgatggaacgactctgatacatgattaactagaggccttggttcacatcattagggctcactctttgtggcgcacatcctgtgggtcttgacaaatgtgtcatgatacgtgtctgacattgctgaagtcaccttttcttaaagcttaacattttgggagtattctgaactatgtttggcccagcctgctgcccgatttttataaaaaagaaaaaacaaaacaaaacaaaaaaacaagttaaaacgtaaggcagatcttgacactgaagactcgatgtgcctggccatggtgcttcccggggcctactgcactgtgaacaaaattgccacagtggagttgtctgtccaggcacacaacgtgtgtgccatggttttgggaaacgctgcccattaatagccctgcagccctctgtgggctgccctcccggccacaccccgcttccctggtctcctccagggccagccatcctgctcgccgacctgggcaccttgcttctgccagagcacaggttcatgccctgtcttcagggcctgggccacccccgtttctcatctatgcagggtcctaagcctttgggtcccacagagcacgacttcgctccgtgaacagcaccaacccaagtctgttccatgtctccacacctgccccttccgctccataggcagctggtgggtgagtggagtcaggagagaaatgcgtggcttctccaattccacacttgctggaggttggggagtctctgctccaggccacccctgcccgccccccagagctgttgtcctcatccgccctcctcctcctcgccggcctgagtgaggttctactctgtgacctagtgccttcttgttacagcggaagccatcacctggatgcctacgtgggaagggacctcgaatgtgggaccccagcccctctccagctcgaaatcgtaagtggctggagtgtaaagaacacacatgtggccttgctgctgagggtggggccagctgcccggagcacaccgccaggcggacctcgtggaggggctggcgggcactggccgggggtctgtgcaccgggaggtgggtgcccatcgagtcaagccaagtgcagacctgggggctcctgttttctaagacaggagccccctgcctccttgtgttgtctctgtggcaaaagaattctataggcgggcttcaaatgtcggaccccaaaagaatttcttctttttcactcttctaaatgaatggctctttcattattgagtctccctttggctcttgtgccgcagggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtggaggttgtagtgagccaagattgcaccactgcactccagcctgggctacagagcaagacactatcttagatcaaaaaagaaaaaaaaaaaaagaaggagaaagaaccagagaaacataaggaagagtgagaggaagaaagaaagatgcaatttgggaagaaatgaaaaagaaatgaataaagaataaaataatgtaacggtcaataaataggacttgtgaatggaggcctttaggccaaaggctatgattaatttcaagctatgttactgaagtccataaacaaaggactcagatctaaatggatgaacgaatgactggaagaaagggtggtaggaaggtaggaagaaaggaaggagggaaaaagggaagagaggaaggaaccttctttccagtcctgtgttctagacagtggaatgaagtggtccccagggagggtggctgtaggcatgtcatgtgcttgtcacatgcacttgccctggcagggaggagctggctcaggaagaccctggtcttggggtgctgttgccctatcttggctgtgtgggccatttcactgcatctgtctcttcctcagtttccccatctgtaaacctggagtggcaccagctgcctactagagttgatcttatgtgtctctgttgatggtaccccatctatggcctggataggcaggaagggcttggaccctgagccccgcagaaggttgcatgaacgagtggtgtgaagcctgttgggtagcttggccactcccgcggcatgggtcacctgcacaggaggttttgcccaccagggggcagcagagggtcagggagcaataggccctgggtggagcatgggccccgcctgctgtgtgccaccctgggtgtggcacctactcacatccaggggttggtgcagggaaaggccagaaggtggccaggcgcacctgagaagggggacccagaagccccgggacccaggagccctgggcaagccaccagaaaccttgttcttgcaactctctgcagtgtgcccaggccaccctctggcctggtcttccatggggcagggcgcccacccttctcaactcaggtttccctgggcagcaggtgcacctcagcacccctggggttgcagaagtggtccggggaccctggcttccttgacatgccatccccagagcctggttcaaggcctctctgtcttctcggctgtttcacgacgtgttttgtaacttggcgggattgcgtttcgctgtgtcgaggttgtctcttctctgactcgccctccgggggactgccggggtaaatctggagagttgctcgtgctgacagtcctcccccagggcctccccggttctgttgagtctcctttctctgtagtggaggaaatgtgtgtagttttgtgttgtgtgcctgtgtttgtctgtaaaagcaaggaccaaagtctcccttgttgacctctcaattcctatttgggacatataaaaacactggattcttaacaagcgcccggagcagtaggagcacagcttggatggactcaggacttgtggcagggagcacgtgggaggcaggggagtggggtggggccaggccatctggagtgggaggcgtcatgctcagagtgactctgtagacgctgggtgggatggggagtgcgggcgcaggcatggatggggctgttagctagtgtgatgcttgaggtctgagctgatggcagcaaagtggggtgctcaggaatcaaagctatggggttatagacaggatatgaaggagggagggaggcaagaagaagggggtggttcccacgcttctagctccggccgagtggatggcaacagcatttggaaggcggaggacatggaattcatgtgtcaggagccaccttccgagcctccagtaccacgtgtcagggccacatgagctgggcctcgtgggcctgatgtggtgctggggcctcaggggtctgctcttcttctctttcagaatctggggctccaggctatgccttggctggactgaggtctgggggtgcacttattatccctggggacacctgctgaagcttctccctgacaagctgtgtcactgttggatgaggatggggcgggaggggttcagggcagaagaagaccgggagggtctttcaaaagaactcatgtacggctgttaaaaaaagtcagcagaggctcaggaagacttaaagtgtgcagaaggcggggaagggagggcccattgcatgcaccaagaggaaattggaaggaacaagcgacgttggctgctaggagagcctgctcccaacatctaggggctgtcctgacgggtcacagtgggtcgaactgagccaatgagagcagctctggggagacccactggtgccctggaggctgggtgggtttgggttggatgaattctgtgtgtccttttggaaatgtggaggccatgaggggggatcagggctcttagggttttgacccttaagagttttgtatctgtaattcaaaggttctttagttctgggatgctgagattcgggatagggttcctaatggcacaaaagccagagataaaacatccttcacgtgctccctacccggttctttctgtaccagacccacaaggtccgagttgggatcctagtgctcctgtctggtcagggcctatctttatgtgttcgttaaacttttaacaatgagaattaattctgtctcttgacattgtcatttgcatgctccccacacacaaatcctttcctggtgacaccaggagctacaactctccttggcctcctcttgtgactcccaactccctccttgggaagcttggcctcaggacctctgggatagacaggccacgaatcctgctgtgtcccgttgtgttcctaatataaatggtgtggatggcacttgacctagagcagtgggaaatgcatgcaccactcaacattctgacatgtcacccattttacattcttacaggcatactttttttaaaaaaagagtgtctattctttaatgagcatcccttctttaaaaaaacctaattgccattattcaccacatacacttttttttttttgtatcctgcctcttctatttaattttctgtcatcaacattttcccttgttccatgaatcttcataacctcacttgctgcgttgtgccttgttgagtggctatggcatcattcacagaaccattctgttattcttatgtataaccaccttttaaaaatattatgaataatgccacaactaactgcttaaaacaccctttttttcattcttaagaattatgttcttccacccagaaattatcattgcttcactacagatcagtttcccctgctagactgtgagccccataagggcaaggagcttattgaattggcctttgtatctctgatgcccaacatgttgtagactataaataaatgatgaatgagtggatggaagaatggaggaaggagcgagtgagtgagtgtttggctgatggataagagggtggaaggataggcggaaggatggattggtgaatgaatgaatgaatttcctttggttaagtctcttgaaagaaaggctatggatctttgtatggatgttgaataatttcagtaagcttacagcattttacaatgttcagcaatgtatgaccacttaattaagatatggctagtttgtctctgttataaagtacttttgcattactttaacttgcattgctttaattactaatgatgggtgaacactttgacctatgtttgttaacaaattgtattttatcttctgtgaactgtttgtccaagtcctttgggtcatggctttctgaagagactggtcccagatgtccttgggatgtagggagcccatagctcactggaggcattcaaggaaccagccaggcagccctcagagaaagtagtgtttaggagattctcatggtgtggggttggcctaggtggcctttcaggtctgtttgatgttaggatttgcttctccctgggaagtgggtgatggggaaaaagacaccttccattggcaggtgtagacactgcaggctggacctcctgggtgtgcttgtggactccgatcttgcccttgataaaacccctgtgggacaggaatagctctttgaacctccaaggtccagacagccacatcctagcaccctgtacaatcagttagtggccttcccaccagcgcagtcactcattcctattagatcccgatgaagccaggccctggggtttccattttcccacctcttaggggaattgggttccccgcgtcctgtgatatgtcagcaaatgtcctcagccctggcctgcacatgtggcctcagtggtggtctttggggtttaactgacgaatggaacattttggatcaggactgatgggagaatctcctttcatttttcttcacctggggcaattacattctaaggagcggaataaagggcatgttctgcccaaagcatcagggctcacaggtcagtcacagccatttagggagggcatgtcacccaaggagggctcgcccttctttccagagcatcctccgctctcagcagagctgcttctgcccacccatccctctactatagcactgagcactgtttgcccgtgtcagaatccctcacccacatgtttagcttggtatccgagtttgggaggccggcaatgactttcaacatgaattgctccatctacccatccatgcatttggcctacttatcttgaccccgtgcttttggccttttcttctcctgaaagcaaaccctttcattttgggtgggctgtgtagcgccatgggctgtggttatgaagcaaacaccctttcttgtagctgcctcctccggggttactgccctgagcacgtcccagctggatctcgtctgccactgtcacccatagcttcttccccatggtgctttccatgtgtcacacaccacgactgtgacccagggtcggggtcaagagtagcctggggccaagccctcccacccatgagcggagaagtcctccccaggcctcaccttgcctggcgcatggtccctcccatgagctttgctttcagcctttcagcttcctccacagggtggcagtggttgtaactcatccattcatcccttcatcccttcattcattcactcacagccaacagacgtttttaaaaaattagccagtgctatactagagctggctcccaaggacccgctgccgcattgccttttgaaacaaaacaatgaacacgttggtaaaggggccgtgcttgtgtgtcggtgacaaggcgagatccctgagtcaggtcaggcttgtagattcgagttctgttgcgagtttgattgcccctctgactttgtcccctgtacaactaggttgattaggaatcagccaactgtgttccctgggtgctcagaaatcacagcccatatcctcgagaggccaaaatgagagccagggggttccaagatgagtggctgcttctggccgggagcaggttttcaagtcattagaacactctggcctttcctggaggtgatcttggagccattcctgcccctttcaagaggagttaatgcccagctctgtttagagaaaattgggggagatgattgctcatgtgggtgataagaatcacctcccgtgcaggggtctgcatagaacactccataggcaaacctgggtgtccaaggcacgtggcattttgcaaactctgggtgcagctccgagctgtcctgcaggtcccagaccaggtgagaactccctgagttcctgctgcctgggtcgggggtgaggcataggtcttgggggttcaacctggaattctgaatgtcattcattgcattggagaggaaggagagtaggcaaagccaagaccctggaactggacaaactcgtgtggtttaaagtcactgtgagagctggagttgagtctgcctacgggggaggactgcggcacctacctcgcagggctgttgtgaggagcaatgtaaccgtgattttgaactgtgattctggaagggcggtgtgcgtgtccccggggtgtgccaggggagtgaggagaaaaggccagggagacagcctcactcaggcagctgagtgggagagcatttatctctaaacctggaggggtatatggtgggacaggaggaatttgggcaggaactgtcatgctaggggtttgggggactcgctggacaatgcccctggaccccccgggggtacgcgttcacgctcacctctgagaggctggaaacgcctggctgtgctttctgaatgctgtgtgcttcctgcctctgtgcctggcctgtgtgcagcacctacttgtgtccgccttcaaaaggcccttctgggtggcgtccttttccccaaaatattaggcaccagccatcaaagatactgcattgttgcctcccccacccctccccccgactgacaacatttgggctcaaatgcagcaggctgggtgcccaacacagtgcctggcgagtggtagcgcttacgtttcttttctgttgaatggatggatagctaatgaaattgtaaccaatgacaagccttgatgtttataacctttactaagagattattattttgctcttcatggacctgttaacaaccaccatattgtatcttacggacgtttgtatgccacgtttgaagagcaggagccttgtttcggcgtcatgttgatggaacttgagctgtctgatgcgaatctgtgttttatgttagaaagcgcgtagccttaggatctggcagacccaggggccacttaattaaccctttgcctctttgaccctcaatctccttttctctaagccataggtcacctgaaagcctacctcacagggctgttgtgagggccgagggtgggtgtgtttcaacagtgtgcagatgctggctttccctgggaatgggcatatgttgggatttgtcttgaaagcatgagtgatggctttactagtcctaagtgaataaaaagtcagccctgaccttacgctgggattgcatttcccacagtcagtggcatgtgcagaccactggcagagcagcctgcaggtgcttagcgatgtgggcccagagtaaatatttgtttgattgatgagtgatggctttttccttcctcagagtttgccctgccccccattccaacgtgggctgctgcttctccccagcgggttgtagctggcagggccgttgtgctttggggtttgctgtacctgtcgctgccgtgaggggacgatctgtctgcccggaggggtttctgcaaacattcatgtatgcccctgctttcgtttgttagggagaaggagtggggtgacctagagagaggatgaggaaggggttctgggtggcatccttggggtaccaaccctgcttccatcctgcgctctgaatttcctcacagcccttttctgtctctggtagaaggtgcagaaggtaggctttgccaccttccctgggcctggcaccaagctcgggggtcttgtacacactttcccttctctaactggggtgtgggcccatttcctagatgagcttgctgagaatcaggacagctggtatcagagccaggacttcccagtcttgcacaaacaacctgtgcatttttgagtccaccaaataaggcctcctgcctggtccggctcacccctgccagcccccagcaaatgcagcctggtgcgtccccacccctgccaagagcccaggagtgctctggcagagaagtgcagggatgaggaaggaggctgtgccctccaggggactcagctgcgttagaggaggtgctgctgcagtggcaggggtctccagacatcccacgcaggggtcctttcagatcaggcatctcttcaccagaccaccgtattcctttttcagccctcgtctcttgcacgtgggggtgcagtgtttggctctcacatccccacattccagctggtgggggtttgagctgggtgttccttctgctccccactccccactcacggcccccaccccacgcaagcctcccttgcccccactctttgtctccagctttcacagccttggcgggcaggctgctgcgcctgttgctgccccggctctcttccacccgcctcttctttctcagcctgagctttaccgtgaggtctgggcgccacaccttggcccctgccatgcctgctcccagaagcacccacgtgggtcccctgattctctcctcccctgggctttgctaaggagccctttcattgtggcctttggtgtctgcctcatgcccatcccctgttcttgagaacttggaagcagagggggcccctcctattgctcccaagaggctccacagtagggagcccctcccaggagattctgagtctgtgtttaggtgtcgattcctgggtgggccttggggtcccctcaggccaggcctgtgtgtgacctaaggctggggggctctgtcaggcacctagtgtcccttggaggtgggcggggctgggtcctggtctcctgaggacgggtggggagacaggctcagggagatttccacgaagctgcccttgaacccctcctctgaggcccacactgccctggccctttacaccctgcctcctgcactagtaggcacataatagatgctcgccacctgtggagggcagggtttaaatggctggaaagagctgagtgggctgtttggctagcgtacgcgcatttgtttaaaaggaaagggtgtgtttcttggcaaagactcttcggaggaaacgctgaactggggatgggtctctacctgttctggggcctcactgcccttcctgccggggacaggcagtcactggtgggtttccccccagtggaaacacaatattttggaaatatttgtatctaggataaaacttcatctggaccaacatgtctttgttggtgttgtggcccaggtgattttgagaatgtagaatacatttggcaatttccaaacggagtgatgacctgctcctccgccccccatgccctccctgaggctggaggcttcagaagcccctgccttgggaggaggctgttctacctgagaagtctttgtccccaccgttggtgacaatcagcattgacctgtgaggcacctgccaggttcgggacgcagctttagacatccagaaaaccgggggtggaggggtggggtgggggcttaagaccccagagcttgattccttttaactgtctcatccccaaagaatggtacatgggtaccaggtaggttacttgaatcaccctgagcctcgattttcccacccgttagaaacagggtaattcatgacagtgtccgcttgggagacggctgtgacccctgagaattctcgctgcatgccgtgggctggctcgtgagactcaaggtctgggttcgaggcccccgcaaccccttctgactgtgtggcctgggcgagtttgttgtttgtaacctggaaagcgtcacacctgcctggcacggttattgtgggcttcaatgagattgtttgtgtgaaataaacgctttgtgactggcacacaggcgctctcatcccggctctcctggtgggcccggaccgctgggtgctggctgcggaggccctgtgctccctggaactgtctgcgctggtcccagggactcttgggcagagtggagggcaagggggaaagcaccagcctgctctggggagacagtggcagagggaagtgtttgcttttaaatacactcagcaggttcagacaggagaggatccgaggggaaatgtttagagccctcaggaggaggaagagaccgagttttaggaaaaacatcaaagctggataggttgggcagaagagctggggatagcatttagagaggctgagagtcctgggttctgggttatcaaggtgagagaaaccagaggttgccagttgtaggtgggcgtcaggactagagtgatgcttccagaagtttctgcaagtgggccgagtctaaggtagggcagggtacgccagaagttgaggggcactaggtagacaggccgagctggtggctgggtgctcccctcaccctccatgctgctaggagcccgtgagcagggacttgctctcctctccctccctcctggggcctgcctgtctgtctgtgaactcttgtcggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaact

SEQ ID NO: 9215 - DNA, 441 bp, Homo sapiens
tgctccctatggggaaggagagaccgactgcttttgctgccacagccaccacggccatcacagctaccacggccgccactgccactgccactaccaccaccatcacaaccatggccgccactgccactgccacctcctccctcttctccttgctctcctcctcctcctcttcttcctcctcttcctccctcttttccttccgtctcctcctccctcctcttcctcctcctcttcctcctcctcttcctcccaccttctcttcttcctcttcctcctcctccttcttcctcctcttccttcctcttcttctttctccttcctccttctccctccccctctttctccctcttcgccttcctttcctgccttcttctcctcttccttttcctccttcctttttcctttccttctccctcctcctcctctttctccctcttcttc

SEQ ID NO: 9216 - DNA, 1610 bp, Homo sapiens
gagcggactgacattacctcatcatagaagcccacgggaaaagaagacacatcccccagacctcacctaagtgggagtccagagagcctccttgatttaagtggctgtggctttcaaaaagtgttaaggaattcaaaaaaaggagagatctcttagaactgtagagggaaaaacagggggaagtatatttttgtggaaggatttagagatgaggtgacactgtggcagggcctcagagaatggggagcatttgaacttgggaaagtcggggaaggaaaagcatgaactaaaggaagtctgaaggaaaatgtcaattatggggtattgcaacaaaaattagtttagttgctggactagttcaggagggagaagtggtaaaaataacaaacttttattgagcctttacaatgttccagggacaatggtgagcactttatatgaataatttcattaatcttcaaaacaatcctatgagacaggttctcttgtttcctccattttatacatgaggaaacaggaagcttagaaaggttaagcaatttgttcaaggtcacaagaggcagaatcaggtatttaacccagaatcaatgctcatcaccacaacactatcctaggattagattatgaggaaaactgtgctggagtgaaggcctgagactatcttcttcaagtagaagggagccactgaaggactttgaacaatgagaatgacataatcaatgtcattctttaggagggtcaaggtaataatacaatgatcaaggatcaagcatccaaaatacatgcaagaaagacccccaccaagacttcttacaaaagtttaaaaatataaaataaaagtgcagctttcaagcaccaaggtaatttccctgcttcagctaccattaaagaactgaggcagttaataagagaaagacagtcttcatctttccccacctgtatttcatgaattgcttcaggacgtcaggctatggggcaccagtacagaggaggctagagagacaaatgaagcaaatccccaatggtggctgttggaaggtgcaacacaaaagtttcttcatctttaaaacctgcatggaagtaaagatcaattacccatagaagtatggggactacctgtgacaaaatgattaatcccagtgggtggccctactgccaccttgctccttttctgcctgcagtggtatgagacccttagctctttggatataaagagatggatataaagtggatgatgcgctttttatagcaatgtaacacaacaaaatgtgacaagatatggagcagaaaaaacagatataaaaattacttcaagggtgcagtgctcactcttgtaatcccagctgcttgggagactgaggcagaggaatacttaagtacaggagtttgataccagcctgggcaacatagcgagctcccatctctaaaaaaattatttttaacttagctgggtgtggttgcatgcacctgtagtcccagctacctagaaggctgagacaggaggatcccttaagcccaggagttcaaggctgcagtgagctatgatcatgccactgcactccagcctgagcgacagagccagactttgtcacaaaaaaagaaaaaaaaaa

SEQ ID NO: 9217 - DNA, 1610 bp, Homo sapiens; identical to SEQ ID NO: 9216

SEQ ID NO: 9218 - DNA, 1610 bp, Homo sapiens; identical to SEQ ID NO: 9216

SEQ ID NO: 9219 - DNA, 514 bp, Homo sapiens
aacaccctgcctagatcaattgggctgagcaaaaccacaggcagcaatcctcaagcccatttctattcttctggataaaaaagacattttttttttttttcaaaatataggggatgtcatctttttcccagccatcttgtgagggaagaagatagcaagacagaaataactccttataatcttttcaaataccaaagcattccacttcccatgcaatcattttgaacctctaacacgagcaaaaactatagctgttatggagaaaagaactcttagtttgaaaagatcgagtactagcatatagaatcccccaaaccactttaaattaatgagtcatacaatatatctgacatgttaccaaatcctccccagacccaaggctcaacagtttttgaaatctcaacacacattttctgaggaattgcagtttggaatgaaactagggcttctggtggagtgatctgtacagtagtcacaggatggtcctttcactgaataaatactttttgagcaa

SEQ ID NO: 9220 - DNA, 514 bp, Homo sapiens; identical to SEQ ID NO: 9219

SEQ ID NO: 9221 - DNA, 514 bp, Homo sapiens; identical to SEQ ID NO: 9219

SEQ ID NO: 9222 - DNA, 3845 bp, Homo sapiens
ttatttatttttatgaaaattgtggacacataaccaagataaagaagtcaggtattccatagccattccttatctcctttctgcttagttgactttctagctgagtggtgcacagtgcatggaagattccacttagccggaccaggaagcttggtctcatctgtggtgcacaccaacagcaaacattgatgtaattctctacaacttaatctttggcacatagaggatttgggggtctccatgttcagggcacaatggctttaataagtgctggaaaatcactgaagctaaaccaagagcaccagatcctctttacctaaataaccagtctttaacatgagctagtccctgtaccatagtattgtttcagctgtagttggttgtcatgttaataagacagctgcacgtctaccttcttttcttttgatttccattgtcttggtaagttattgttagggttatttttaatgtgccttccagccagaaaaatcagctgtctaaagaagcattgcaattgtaatggggactcttacctcttagaatgcaagattttccctcctccctccctcttctccatctctttccctcatgatttgagaactgtaataatcctccactggtggcattacctacctagaaaacctgctgattcttagcatggaactttgcttcagtttgcaggacaaagtctgcttccttccggtcttcatttactttttatacaagggatgcagtcagctctccatgtataagatacctagatgatggatacatatttcataaatgaaatttatgtcattaatgaatatccccttgcccacaaccagctcaggctttcaaaattcgagaatggtcatgccacacagcattctaatctagatggattaattctgttgttcaaaacattctcatacctgcctttatattgaaaacaaattctagatacaactggggttattctggaaaagcacattctcaccttttttttttttttgagacggagtctcgcactgtcgcagggctggagtgcattgtcgtgatctctgctcactgcaacctctgcctcctgggttcaagcgattctcctgcctcagtctcctgagtagctgggattacaggtgcccaccaccacgcccagctaatttttgtatttttagtagagatgaggtttcaccatgttggccaggctggtctctaactcctgacctcgtgattcacccgccttggtctcccaaagtagtgggattacaggcgtgagccgctgcgcctggcccattctcatcttattcaaattactggcacatgggcaagagagacaatgacatggatagaagcttttctgcctttctctgcacacacatacagtgaaggaaccacaggcagattttttgatcagtttggtgaatacattgctcgttgtcactgttccaaccacattggtaaaaaaaatagttaccttttgtcctttggatgtcatgtctaaactttggaaaatataagtcattgcccttttagagaatgtttgtgtagtccaaagattgtgagctccatatagtatgaaaatcaagtacttttgcatgagcaatagcagtttcaaagtgaaatattataatttaatctttttcaagtagatcaaaaattcttaactgattaataaaatattttatcaatatatcatccccctttcagagagaagtccccagaagagacagcacacttagcaattgccctcattattaaaggcctaggtgagtggcataaagggccatatgcgattatgtttcaaggtaaacattacctaaccttgtgtgggttaaaaacagtgaagtgtccttgtatcctgataaaatttttttttaaataacatggtgggttgacatttttgcatctgctataagttttctcacatgtcgttcttcctggtgagagcgggctgcatcattctggcacttaatttgggtgttcgattttgctatagagttctttgcagtacagcatagcctcttcttggccttgggaacagtgaactcttcttttgatggtgtggattgcatgcatatctggagagaggagggctcaggactgtgttcactttatttggtcagatgtattttatttgaaaaccatttgagcccaaaatacaagtgtacccttcccacttctggctcaagcacccgtgagccgactagacgtaatattaaaacttactgatgctgggtgcggtggctcatgcctataatcccagcactttgggaggccaaggcaggcagatcacctgaggtcaggagttggagaccagactggccaacatgacgaaatgctctcgctactaaaaatagaaaaattagccaggcgtggtggcacacccctgtaatcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcaatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtacaaagtaa

SEQ ID NO: 9223 - DNA, 3844 bp, Homo sapiens
ttatttatttttatgaaaattgtggacacataaccaagataaagaagtcaggtattccatagccattccttatctcctttctgcttagttgactttctagctgagtggtgcacagtgcatggaagattccacttagccggaccaggaagcttggtctcatctgtggtgcacaccaacagcaaacattgatgtaattctctacaacttaatctttggcacatagaggatttgggggtctccatgttcagggcacaatggctttaataagtgctggaaaatcactgaagctaaaccaagagcaccagatcctctttacctaaataaccagtctttaacatgagctagtccctgtaccatagtattgtttcagctgtagttggttgtcatgttaataagacagctgcacgtctaccttcttttcttttgatttccattgtcttggtaagttattgttagggttatttttaatgtgccttccagccagaaaaatcagctgtctaaagaagcattgcaattgtaatggggactcttacctcttagaatgcaagattttccctcctccctccctcttctccatctctttccctcatgatttgagaactgtaataatcctccactggtggcattacctacctagaaaacctgctgattcttagcatggaactttgcttcagtttgcaggacaaagtctgcttccttccggtcttcatttactttttatacaagggatgcagtcagctctccatgtataagatacctagatgatggatacatatttcataaatgaaatttatgtcattaatgaatatccccttgcccacaaccagctcaggctttcaaaattcgagaatggtcatgccacacagcattctaatctagatggattaattctgttgttcaaaacattctcatacctgcctttatattgaaaacaaattctagatacaactggggttattctggaaaagcacattctcaccttttttttttttttgagacggagtctcgcactgtcgcagggctggagtgcattgtcgtgatctctgctcactgcaacctctgcctcctgggttcaagcgattctcctgcctcagtctcctgagtagctgggattacaggtgcccaccaccacgcccagctaatttttgtatttttagtagagatgaggtttcaccatgttggccaggctggtctctaactcctgacctcgtgattcacccgccttggtctcccaaagtagtgggattacaggcgtgagccgtgcgcctggcccattctcatcttattcaaattactggcacatgggcaagagagacaatgacatggatagaagcttttctgcctttctctgcacacacatacagtgaaggaaccacaggcagattttttgatcagtttggtgaatacattgctcgttgtcactgttccaaccacattggtaaaaaaaatagttaccttttgtcctttggatgtcatgtctaaactttggaaaatataagtcattgcccttttagagaatgtttgtgtagtccaaagattgtgagctccatatagtatgaaaatcaagtacttttgcatgagcaatagcagtttcaaagtgaaatattataatttaatctttttcaagtagatcaaaaattcttaactgattaataaaatattttatcaatatatcatccccctttcagagagaagtccccagaagagacagcacacttagcaattgccctcattattaaaggcctaggtgagtggcataaagggccatatgcgattatgtttcaaggtaaacattacctaaccttgtgtgggttaaaaacagtgaagtgtccttgtatcctgataaaatttttttttaaataacatggtgggttgacatttttgcatctgctataagttttctcacatgtcgttcttcctggtgagagcgggctgcatcattctggcacttaatttgggtgttcgattttgctatagagttctttgcagtacagcatagcctcttcttggccttgggaacagtgaactcttcttttgatggtgtggattgcatgcatatctggagagaggagggctcaggactgtgttcactttatttggtcagatgtattttatttgaaaaccatttgagcccaaaatacaagtgtacccttcccacttctggctcaagcacccgtgagccgactagacgtaatattaaaacttactgatgctgggcgcggtggctcatgcctataatcccagcactttgggaggccaaggcaggcagatcacctgaggtcaggagttggagaccagactggccaacatgacgaaatgctctcgctactaaaaatagaaaaattagccaggcgtggtggcacacccctgtaatcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcaatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtacaaagtaa

SEQ ID NO: 9224 - DNA, 403 bp, Homo sapiens
agaccctgtatctaaagtgaatgaatgaatggtagcctggaaatttcagttacatctcattttctccaaccagaaatcttgtaccaaagttagaatcaaataactagacttgagggggaactgcaaaatttccagaaggcaactagcagatgaggtaggcaaaggcggtaaatgatttgcaaactcaaccttcaagttcaaaaatggtgggcaatgtgttagattttagtcatccttccacatctcccctaggtccccatttcacatcagtggtaggggaacaaactaaaaaccttttctttgccttgagttttttatttctttttcttttcctttttttttttttttttttgagatggagttttgctcttgtcgcccaggctggagtgcagtgttgtgatct

SEQ ID NO: 9225 - DNA, 19349 bp, Homo sapiens
tcctcctgcctcagcctcccaagtagctgggagtagctgggaatacaggcacacaccaccacactcggctaatttttttttttttttttgagaggaggtcttgcagtgttgcccaggttggtctcgaatacctggcctcaagtgatcttcccaccttggcctctcaaagtattggaattacaaccatgaactagttcacctgacccaattaaaaaaaaaaagattttagcagttcataaaatccaaaagccaactgtaccatatactataccacctccctcagatgagtaccttgaaacaagaagtttacagaatggattggatctgtggctaaatgcacaaaaacttatagaaaaggtaatgtaaaaattgttagaacatagctctctaaagataggcttttgcaaagacattacaagaaaagaatgctattgaccgatatctcttatgattaaagatgagaaaatccttaacaaaatactagcaagccaaatccagcaacttataaaaagtacaatgtacttaaagtataatgtactttaaagtataatgttcctaaataaatggaaagacatccatgttcattgatctgaatacttaatattaaggtggcagtacttttcaaactgatctacaaatgtaacacatccctatcaaaatcccaagtggttttcttgtagaaattgacacacagatcctaaaattcatagggaaatacaagaaaacaagaatagctaaacaatcttggcaaacaacagagtttataacccacaccttgggaggctgaggtcgagtctgtagtgagctatgcttgcaccactgcattccatcctgggcaatagagcgagaccctgtcttaaaaaaacgtcaagagcaacaacaaaaaaaacactttctgatgtcaaacttaaaacaaacttaaaagtaatcaagaaagtgtggcactggcgtaaggacaaacacatagatcaatgcattagaatggagagcccagacacaaggcctcatgcttacagcccactgattttcaacaagagtgacaagacatttcagtggagggaatggtgctgggacaactagatatctacatggagaagaatgaagctgaacccactaccacacaccatttaaaacactaatccaaaatgaggaaaagacctcaatgtaagagctaaaactataaaactcttagaagacatgggtgtaaattttcatgtacttggattacctagtggtttcttaggtatgttatcaaaagcacaagcaacaaaagaaaaaagcacaggcaacaaaagaaaaaacagatcaattggacttcatcaaaagtaaacttctgtgcttcaaaagacagtatcgaaaagtgaaaagacaaccgacagaatgggagaaaatattttcaaatcataatcagataaggagcttgtatctagaatatatgaagaactcttacagctcagtaatagaaagacaaccctattaaaaatgggcaaaggactttgccttagtctgttttgtgctgctataaggagataccacagactggtactttataaagaaaagagacacatttcttgcaattctggaggctaggaagttcaagattgaggggaccacatctggtcaggcccttcgtgctgcttcataacatggcagaaggcagaacagcacacgtgtcggggaaggggtggcaaactcattcttttatcagaaacctacccccaggatagcagcattaatccattcatgaacagagccctcctgatagcctagtcatcatcccttaaaggacccacctctcaacactgttgctttggggattaagttttcaacacataaactttgggaaacacgttcaaaccatagctgacttgaatacacatttctccaaagaagatatccaaatggccaacaagcccataaaaaatgctcagcatcattagtcatcagggaaatgctgattaaaaccacagtgagataccactttacgcccaataggatgactataattttttaaaaacccagataatagcaagggttggtgaggatgtggagaaattgagaccctcgtgcgctgctagaaggagtgtaaaatggtatagctgctttggaaaacagtctggcagttgctaaaacaaacatggagttatcatatgatccagcaattctactcctaagtatattctgaagatcattgaaaacaacgtccatgtaattcgtaatcgctaagaagtagaaacagctcaagcatccttcaactagtaaatggatacacaaaatttactgtagctatacaatggaggagtattcagcaatacaaagaaataaaagtactgacgtgctacaacacggatgacccttgaaaacatgctaagtgaaagaagccagtcacaaaagactatatatattatatgattccatttctatgaaatcttcagagtaggtaaacaaaagagacagcaaatagaccagtgcttgtcctgggtatggttgggggcagttgagaagggctgggggaattggaaggtgacagctaaggggtacaatttgtcttgacagtgatgaaagtattctaaatttgattgtgggatggtagcacaactctatgccaaaacctattgaactgtatgcttgaaattgggtgaattgtatatctcaacgaagctgttataaagtaccacgaaggctttggggtatgccttattttctctgggtgctgagttgcttttgttttgcatgaagtctgttttgagcttactgtcctttccaccctagagctaagcttgtctgctggatccctgcagctggagcgcaaaaggagagatttcacctcttctgggagcaggaaactctacttcgacactcatgccttagtgtgcttactggaagacaatggtaatcctctgtcattcgtcatttagtgccttagaaaaacactttaaattatgacttctcttatggtttcatttaatttctcatgttcctctttgacttctattttttatttgtgtttaattaattaatttatttagagacaggctctggctctgtcacccaggctggattgcagtggcgcagtcttggttcactgtaacctgcctcccaggctcaagccatcctcccacctcagcctcccgagtagctgggactacaggcacacaccaccatgtctggctgatttttgtatctctttgacttttaggcctatgggcaatcttttaattaatctccatttttttaagtcctcattttttgctggaggacatttttgcttcatcaatagaatggagacttttctcacacattgtctctttgtccaagtgaagtgtatttctgtaacatcaccatggaagtacagtgttataggtaaaaatttagacacaagtcagcaaagctgaggaatgattcctatgacaacagtgtctgaagcacagaagtgatagttttattactgtgcatcttgtgtgctttttaaaatcctgtgaaattgaaatgttgctgagtagcagttcttgataatttcaacttactgttcttttttcttttttctttttctttctttttttttgagatggagtctcgccctgtcacccaggctggagtgcaatggcgcgatctcggctcactgcaacctccacctcgggttcaagcgattctcctgcctcagcctcctgagtagctgagattataggcacgagcctccacgcccagctaatttttgtgtttttcatagagatggggtttcaccatgttggccaggctggtctcgaactcctgaccttgtgatctgcccgcctcagcctcctaaagtgctgggattacaggagtgagccaccgcgcccagccctcttttttctttttaatactcaggctaacattcttcgttattgctgttaagataaaagattgttctggtatatatggcattcattgaaaatgcactttagacttagaatgtagggaacattctcatactaaatcatatttagacaaatacaccgattataattctctatatggtgacacattctcaaaaatcagaatttcaaaatagtgtaaattatgcttgtgaaataaatttgcctgtgcttttacttcattgtgtagttatttgtccagttgtacatgtttgtgtcagaaaagctactctctgtagaggtactttacatgcctaagacaaagtgacggaatgaattattctgtgctttgtgggagacagcagctctgggctcgagcctaaccctgcagacttctagttgcctagcttaggaagcttttttccccttctcagtttccatttatttgcccatctatagtatgagtgtaatacgaattccaaagacctttttgaatattaaacaagataatacgcatgaatgaactttggaaaaactgtcatatgctgtgtaataattttcacaacttttcctgtcaaacagtaggcttttttcgccaaaacttctttcagtacagaatttaaaagagaaaagtagaagcgagaagggagcatgtaaagttatgctgataaggccaggcgaggtggctcatgcctgtaatcccagcacttcaggaggctgaggtgggaggatggcttgaacccaggagttcaagaccagtctgtgcaacatagtgagagcctgactctaccaaaaaaaaaaaaaaattgataagcagaagtcttcctagttttcttgattttaaaccttaacccatggttatttgcatctttcaagactgtggtgtgagggccacactgcagtacgtggtatggaggggctgttcaatccaacatggatgagttgggggtgtctgagatgactggctgagtaggaggccaggaaggacttttcaaggcatattctaccctttctttatccagacctgtgtcttcaggttaacaaaatttctcatatgcctgtcatctcaccctggttctgtcctattccctcgtgtctacaaaaaattaatttctgcctcataactcagtaggttttcagacttccacttttttttttttttttttttttttggagacagagtctggctctgtcttccaggctggagtacagtggcacaatctcggctcactgcaagctccacctcccgggttcatgccattctcctgcctcaggcttccgagtacctaagactacaagtagctgggactacaggcgcctgccacaacgcctggctaattttttgtatttttagtagagacggggtttcactgtgttagccaggatggtctcgatctcctgacctcgtgatccgcccgcctcggcctcccaaagtgctgggattacaggcgtgagccaccgcgcccggccaagacttctactttttcatatccctttctcctcccacaagtggttataaagtatatggctttagagtttgttttacaatcaacataagttctctttctacctttatttttcttttcctcatcattgccaaacctaatttttttcttttttttttttttttttttttttttgagacagaatctcactctttcatccaggctggagtgcagtggcacagtcttggcctactgcaacccccacctcccggtttcaagcgatcctcccacctcatcctcctgagtagctgggattacaggcatgcaccaccacacctggataatttttctgtatttttactagagacggggtttcaccatgttggccaggctggtctcaaactgctgacctcaagtgatccacccaccttggcctcctaaagtgctgggattacaggcgtgaaccactgtgtccagttgccaaacctaattatgtttaaacatgaactctttttttaattaaaattttttaaaattttatttacattaaaatggagatgggatcactatgttgcccatgctggttctgaactcctgggctcaaagatcctcccgccttggtctcccagagtgttaggattacaggcgtgagccaccacacccagccagtgaactcttcttaataaaactttaaaatttggcaaaagtttagtttgagtttttaaaaactaggaagacagacgagaaaaaagaaaacagagtcagagctaaacaatgttaacattttggtgagtaaccttttgtattttttttctagacatgtgtataacatgttgaaaaattaaagaattttgacgaaagtgatgggaataggtctttggaggtttttttccttctcctttaaatctgtgtctttggtttttttgttcattatagtcccatgcttcatctcagccacacaaattccattaattaagtactactttattccaagaaatacacaattaattacaggaatcaatagattcttctgaaattcttatagctggaagcatttaatagaactatttcccaggcactcagttttaagcatttaattagaatttatgttaaataggagttactatccaatgtttttaaaaacaataccaagtactggccaggcgtggtggcttgcgcctgtaatcccagcacgttgggaggccaaggcgggcagatcacctgaggtcgggagttcgagaacagcctgaccaacacggagaaacttcatctctactgaaaatacaaaattagctgggcatggtggcgcatgcctgtaattccagctactccggagtctgaggcaggagaatggcttgaacccgggaggtggaggttgctgtgagctgagatcgcgccattgcactccagcctgggcaacaagagcgaaactctgtctcaaaaaaaaaaaaataccaagtactgcattgaatctctatcattcaattcagtatcatttattgactaccaaagaacatattttttctactttgggtcccccagactagttactgaagagaattgtggaggaaaaatgaaagaactgattttgtcttttaacatgaagttagccaacagctagattactatttatatagtcaatgatttgactgccttatgctggacataaaacaactgagctttcctatttaaggaaattattttttaataatgtacacattataaaattaaagaaatattgtccaccgtagaaaatctacataatgcagagaaacataaagaagaaaataaaaatgactatgaatttttgttaaattataaaaacaagaattgcatctgtaattttgagtcttgccttttttcacttgatgttgacttgccggcattgtctatgtcattaaatagtctctgaaaacatgacttttgatagctaggaacgacttacagatcagtcagcaaagccaccggtacctggggaagccaacttgtatgtttcgtgcttgctctgagtgaccggcacgtcatagtttgtggctgtaccctcctccctgcctcctaccacactgtgctgtactcttcctcctggatttggacattcacatgaatgtgtgcatttgctgtgggcttttgtaactctgagcatgattttttttgcttgtgtgcttgcttagggtttgctactcaacaagcagaaatcattgtgtctgcattggtcaagatcctggaggccaacatggacatcgtctacaaagatatggtcaccaagatgcagcaggttagccttgttgggtggtttagcaaattaggactgtgaagatggggtattatttgtagtaatgttttaatataattttttggataataccccgttgaaaagtatatagtaacttttaccatgattaagaggcaaaagattacagtggcataaaaaatacttactcagaactatttagtcaacagttgtagaatcgttatgcttgaaagctcactgttcaaaattattccagtgaaatatactttaataaatggagacgtggcctgaattgtagtattatagcatcatgttctcgagtcttcacatcaccacccttttagctgtgattcacttggtaacaataaccagatatgtggtttttgtttttttgtgttttgggggggtctttttgagacagggtatcactcatttgcccaggctggagtgcagtggtgcagtctcagctcactgcagcctcgttgacctcctgggttcaagtgatcctcccacatcagcctcccaagtagctgggactacagccgtgcactgctacagctggctaatttttgtacttttggtagagatggggtttcaccatgttgcttaagctggtctcgaactccttggctcaagtgatccacctgccttggcctccccaggtattgggattacaggtgtgagccaccttgcctggccagatatgtgttgtttttttcttttccttttccccttttggaataaaggatgaccctactgaacctctttttgtgtccacattgtcctggtttctcaataagaagatagcacattgagatgataggaagtggactttttagggtagactagattatgtgttttgtttttcttttcctaggaaatcacttttcagcaagtaatgtctcagattgcgaatgtgaaaaaggatatgattattttggagaagagtgaattttcagccctcagagcagaaaatgaggtaaaacagagcctctcacacttagaaagttgattatattaagacattgagataaattatatacacataaaagagcacacgttaagtgtacatctcagtgaattttcaaacagtgtgcacttccagtcagatcgagcaggaaaacttgcccactgtcccagaagtctctctcatgcctctcagttgctcctgccccagaggaaacgctgtcctggctgataacaccattaactagtttcgcctattctagaaccatttgatggtatcatactgtgtgtcttgtagcaagagatcatttttttcattgtctatagtcttaacatcaataggccccatcattttattgtaatgtgtattagaattgtttccagtttttggttattttgaataattgctactgcgaaatatctcttgtgtttctttaaacagagcatatgggatcagcatttaaataagtgctgtctatgcattttccttttattttcggtcctatttaaagtcccataatagggaaggccatttattgcctgttgaccctagccttgtaagaaaccttctagcaaaaagtaaagtggtaaagtttcagactctctaggttgttcttgaaatcagttatttgagggtaggattagttaaaagataaaccgaaggagatactaaataaagcagggtcactgaaggcaaatgtgtatgccaaacacaactgagttaactttacatagccttcaagatgaattcaaactgatttcaagatacgtgtgttgtaatgccattctgcaatcaatacggtgttctgaatgaaggaaaaacctgaggaacttgtgcataaatatgtattgtaatatttgttggttactacgttttatgttgttctttctaatgactttttttttatgtgtttttagaaaataaaactcgaactacatcagttaaaacaacaagtaatggtaagattcactttcctgtttgttggctggtttgtaattatataaacttattaataagtataatattagaaatggatgtttttaaaaacttaattctttgtgaaatgtttgtgtaatatgcctcaaaagtacacattggaagatttagctaagaacacagccaatgaatgaattactgttgtctgtaaccatattcattaagaaaattgtggccaggcatggtggctcatgcctgtaatcccagcactttgggaggccgaggtgggtggatcacctgaggtcaggagttcagaccagcttggccaacatagtgaaaccctgtctctactaaaaatacaaaaattaagtgggcatggtggcaggtgcctgtaatcccagctacttgggagactgaggcaggagaatcacttgaacccaggaagcagaggttgcagtgagccgagattgcgccattgcactccagccgtggtaacaagaacgaaactgtctcaaaaaaaaaaaaaaaaaaaaaaagaaaattgtgttctaggaggaattaagtcatttttaagtaaaagtttttctaaagtgctgcacggaaggaacccttaaattctcttagactgtctttagagaatcacacgtgatttttaaatgcttactgtgccagctatttaatgttttttaaatagaaaaaacatagatgttaaagaaaaaaaggctttgatatgtatcagagaaaaggctctatgtaaactggattttaatattttgctgctttgagtccatctttgctttccaaagttgtttaagatcagctttattcataagttccattcggagattgtatgaggagtcttgaggttaaaagcagcaacaggccgggcgcgatggctcacgccagtactcccagcactttgggaggctgaggtgggtagatcacaaggtcaggagttcaacaccagcctgaccaacatggtgaaaccccatctctactaaacatacaaaaattagccagacgtggtggcatgcacctataatcccagctactcaggaggctggtacaggagaattgcttgaacgcaggaggcagaagttgcgtgagcagagatcaccccattgcactccagcctggttgacagagtgagactccatctcaaaaaaaaaaaaaaaatggcagcaacaacccactctagactggcataagcatagaagggggttatttgtgtctaactgggaagtcctgggacaggctgcctccagatgtggcttggccagagttccctgatgccaggaggcctaggtccatttctctggaagcccctggctctctccctccctgggttgcctcgcctaggatagggacagtgggggcagtggtcccagtgtcacgtcctcatagagtttgggtttcttactttggatttttccttctttgttgtttgccctccttttaggatgaagtgatcaaagtccgaacagataccaaattagacttcaacctagaaaagagcagagtaaaagaattggtacgttcctttactaaaaacacattatgaattaatttatttttggaatggaatgcttggttaagcctaagtttatgtacatgtcataggtactgttaaatatttatctgtttatcagtgttaggctgtattttctctattataataattttggattaagacttaaatttgttgctttcaaaagtaacattaaaattaaactcctagtcaaattagtcagtttgaatatttgtttcagaaatattagagatatgttacatagagattcataaagaaattaaatgcaatcttgatctatttaatactgacttaaatcttcataggtcttgatcttgtaaaagttaagttgattatttcaggcttgaataatagtaaattattaacattaaataatattaaattatatactggaattcaagattaaaacatttctggccgggcgcggtagctcacgcctgtaatcccactactttgggaggccaagatgggcagatcacctaaggtcaggagttcgaggcagcgtgcctgcccaacatggtgaaaccctgtctgtactaaaaatacaaaaaataagccgggcatggtggcgggcacctgtaatcccagctactcgggaggctgaggcaggagaatcgcttgaacccaggaggcagaggttgcagtgagctgagattgtgccactgctctctagcctgggtgacaagagcaaaactccatctcaaaaaaaaaaagaaaatttctatgttgtcttttaagtgcagtgagaagttgtgagggtattttgttttgttttctatttttgttttttttgagacagagtctcagtgtgttgccgaggccggagtgcagtggcaccgtgtctgcccactgcaacctccgtctcctgggtttaagcaattctcctgcctcagcctcccgagtagctgggattacagacgccaccaccacacctggctagtttttatatttttagtagagacagggtttcaccatgttggccaggctggtctcaaactcctaacctcaagtgatctgcccaccttgtcctcctaaagtgctgggatcactggagtgagccactgcgcctggccggcaagtgtgttttttttttctttgtttttgtttgaggcggagtctcgctctgtcacccaggctggagtgcagtggtgtgatctcagctcactgcaagcttcgcctcccgggttcacgtcattctcctgcctcagcctccagagtagctgggactacaggcccctgccaccacgcccagctaattttttgtatttttagtagagacggggtttcaccgtgttagccaggatggtgtcgatctcctgacctcgtgatccgcccacctcggccttccaaagtgctgggattactggagtgagccaccgcgcccggcctaagtgtgttttaataaagatatgtgtcgggttgcctctagtgatttttaaccctgtctgaatattcagccgtcttcttgctcagactttatttgaatttggtaacatcaggtgccttttttattcttagcataatgagaaatagggcagagagagcatcttgcactaacacaaaactgaatacacatgcagaaactgagtactcacaactgtttgttgttttctcatttttgacaatttgcttttagataaaatgtgctataatgataagtgaagctaatactgaaactcaaaaaagtaacctacttgtgttttggaactgccactggatttcaagagttaatccaagcttcgttatacaaaataattattaaggctgtgttacctgtctttctagtcttacaacaacagtctccacccataaagattaaatcacctagtgttactaaatagttactgactatagcatgtcactggtgtctggaagaggagaaactcttttggttacctttatctttatgggttgtatactcaggaagaactgaattcacttgatataggaaaatgactgtgtgtagctaaccaacctgggaaaaactacatcaaggacatcaggaaatacagggcatgaatgtagattaaagccagtgaatttttttaaaattttatatggagtcattttaataacataactaggctgatatatatgtacatttttcaatcatgtaacatttagattttactcattttaagtcattaacatcatccagcaaacaaaaattttccagaaatttttttcacaattacagttttagtctttaaaccaaaatgaaaaaatttctgccgggcatggtggctcacacctgtaatcccagcactttgggaggtcaaggtgggtggatcacctgaggtcaggagttcgaggccagcctggccaacgtggtgaaaccctgtctctaccaaaaatacaaaaattagcccagcgtgatggcccacctgtagtctcagctactcgggagactgaggcagaagaatcatttgaacccaggaggcagagattgcagtgagccgagatcacgccactgcactccagcctgggtgacagagtgagaccctgtctcaaaaaaaaaaaaaagaaaagaaaaaaaatgatgaaatttcattcttgcaaatactcatatttttaaattattggatatatagagtggattcattcagtgttcttataagaaaagtaaagcttataatattttgcagacttgataatgcagcactcaaaatacttaccctgattttattttacttgaatttactagttaaatatgctgataaatatgatttacatgtaattactttatctggaatgactatattgaccttaatctccagaaagcaaccaatgcacagagtttcaattaaatcctgtccatcatgatagtaactttttctacatgacacaaaagtgtctgtggtatatttgaacagtaactgtgactatgaattgttcttatagtctttttttagtgtttcattattttaatttcagtgggttttgggggaacaggtggtgtttggttacatgaagacgttatttagaggtgatttctgagatttttggtgcccccatcaccctagcagcgtacactgtacccaatgtgtagtcttgcccctcacccacctcctaccctttcccccaagtcctcaaagtccactgtatcatccttttgcctttgcatcatagcttagctcccatcaagccagtgaatttatgtcatttagtaacctagcggggaggttgttcttggtaatcataaacttggattactctgaagcacaaggcagtagtaaattatacagcgagtgtgtttgtaacatgcattggtgaagatgagttttctggctctcgttctttcggtaaagttataatgttaaatattaaattgcaaattaactatgatatttacagccagttccaaaagcagtatggcatataaacttctggggcatggggatatagagctacatagatgttatttttaaaaccatgacagcgtcaatatttaggctcttcttttgtgggtgagtcaatgttgagttaatgaagactgaggtttagtggtgcacaaaatcttgttccacgccgccctctagtggtgatctgatgcatcgggctctcctggtctgaaaccctgaggtttaaagagcattgttcttggttttacaacctactccttggcttagggttttggggttttttgtttttgtttttgtttctctttctcttttttttcttttttttttttctacttctaagctcccagtagtcccaggagaatattttatagctaggaagtttctatatacttcaaaggattaactttttctttctataacaaggttaatgtagttcttaaaagtcgtcattcaaattactgattgtcatatgctcaattaaatcttgttgcccactactaaggagataagtctgatttcaatcttactgtctacaaaactgcactaaatcttttcactgacattaatagccaaaaggcgagatactttaactctgggtagaattagttcctttagtaacgctggattatggctacgcccaagtgggtttttttattgttattaaaaccaacatgtgcaggaggctaaggcaggagaattgcttgaacctgggaggcagaggttgcagggaccccagatcaagccactgcactccagcctgggaatagagtgagactccatctcaaaacaaaaaaccaagccaaaaaaaaaaaaacccaacatgtgatgagttagtgtatttatgtatttacattgtattttataatcacaacacaatgtctttgtcatagaataataatccttggcagctatttgttccccaacttcataccttttctgtcttttgttgagactcaagtagtgacgtgttttgctactagttatgatgggatagctcctaaattgagttgagtctccattttcaaccctctcaaaaccaaaaaccatatgactcagcatccttcgaaattggtccccagggagtgctactacaatagtgggagggacctaaagacatcacaggaaatatgcagggagaagtgacagatgactaaggaaatccagatattagaggaatgagtaagtataaataagaaactttagccagcacggcaggtcatgcttgtaatcccagcaccttgggaggccgaggtgggcagattgctcgagctcagaagtttgagaccagcctgggcaacatggcaaagccccatctctatggaaaaaaaaaaaaaagaaacctcaagtaacacatataaagaagcaggtaggctacttaatcccagaggtgactttctggtgttacgtattctaggaggtactgagaccagaatatttaaggcaccagagaaggagaagagagaggagtagatcagaatctgacccatgttacgtgtttatttcagtattcattgaacgaaaagaagctgctggaattgagaacagaaatagtggcattggtaagaaacaagactgtgatttttctttgtctttgtactcatctttgcttcgttccatgcatggttgtttgtaatgataataggaagttacatgcaggtttactgtcatgggaattttttacattgtgctaaaatacacacaacataaaaattaggatcttaaccattttttaagtgtacagttcagtacatttaaagtacattcacattttggggcaaccatcgccactggctatcacagaactctttattttgcaaaattgaaactctgcaccctttatacattcccttttccagcctctggtgacctccattctactgtctatggatttgactattctacatacctcatataaatagaatcatagcatttgtctttttgtggctggcttatttcacttaacacagtgtcctgaaggttcatccatgttgttgaaatgacaggactttcttcctttttaaggctgattagtattccattatatgtatatgccacattttctttattcgtctgtcaagggcacttgtgttgcttccacccgttggcctttgtgaatagtgctgctgtgggcatgggtgcacagatgtctgttgggatccctgctttcagttcttttgggtatatatgcagaagtggagtgtcacaggattttttgcacttcacaaagtgtttggttatcgtaatggaagatagttatcctatgaaagatttaaactttcttaatgaaagtttccttttcttctttctttttttttttttttttttttgaggtggggtctcgctctgtcacccaggctggagtgcagtggctcaatctcagctcactgcaccctccttcacctcagcctgtagagtagctgggaccacaggctcacaccaccatgccctacttgagagtttgtttttcttaacggaagttttattaagaaagtttaaatctcagtaattgaagaatagtgaggaatggagaagtcttattctatttttaatttatagcatacatttctccttttccatactgtatggaacctgggacctctgaaacccccaagaggctttcatgagagaattccagaatcctgggatatttctctggaatacttttttacgcatccaggcatttatttctttttttctctgcctgaattggtagccatagggaaagatttagttgctgtaggagttttagtgaaggattcccatggtttttatgctttaatgcagttctacaaccccctatagcgtcggccaaacccactgcctttttgagggttgattatgtgtccagtttaactgtattgtatttggggaaggacacaaattggccgtgggtagccaagcctcatagtaatgaaacacttgatatttgaacatgaaagaagaaagttttttaaaaatatgactagaaatagctcaagacaagcactgccgctttcacattatctaagactccatttcttgaaaacatttttgagtttactgtctatctttgactaaggaggatttagaaggatgagacgtagccgttgcctttgagaacagactggcctcataataccacatcatttgtatagcaacctagagcttacaaatgctttttcacatagattatcgcatttgattctctaaacagtccaggtaaaggcagggccactggcttggttgtttcgttttgttctgttttcattttttcaaatagaagaaaactaaggcctagagaggttaagggtcctgaccaatgcagcgtagaattagggttttagaactgagactaaagcccaggcctccatagtcttacccaggtttccctgtgactgcaccccgttgggaaggagctataggatggtgagcagaggggacgtgctgtggtctaacgctgtgactctcttcattttaaaagcatgcccagcaagatcgggcccttacccagacagacaggaagatcgaaactgaggttgctggcctcaaaaccatgcttgagtcacacaagcttgataatattaaatatttagcaggtaagctattttgtatctatttaaatcaacctgaaaagaaaataaatttataaaataagtcgttgacagatactgcatttcattgattccaacactttctgaaatattttaacatctctgaaattggaaagcatcttacaatttccagtagatgaagtatcatagtttaattggcactttttctttcttagtagtaaataaagtaattgtgtacgttataattgatagaattggaaatttgataagatactataattgaactatagttattagggattttaatgagattcaagacaggaaatattttatggataaaatggaaggtgtttcagttgtaatctttctgcttcaattgcttaaactccttttaaggagttattttactttcgcgatttttgatccaaaagagagaatgaacattcatgtaccaccccccacccaaattaaccattatttcaagtcagatttaacgtcttggattaattaaatattttaaggttacagcattatttaacagtgaaatgttgttctttatattaaattgtgtcttcctgtctctatagtgcatatacatagaccttgtgaccacagaatttttgctattcgaaacttttattgaaaagttttcttagcctaggcaacacagcgagacctagtctctacaaaaagatttagccgggcatggtgtcatctgcctgtagcttcagcttcttgggaggctgaggcaggagggtcacttgagcccgggagtttgaggcacagtgagctgtaatcataccattgcatggtgcactcctcctgggtaccagatgagaccatgtctctaaaataagaaaataaaataaagggtgtgggatttgttttttcagtaggcaggcgtttcacggaatatgggacatcagtgagcaatctaagtttctaggttttcttttttaggttttcttaaaaaaagatgttccctcaagtaactcttaatagaactaatagtactctcaattgtttttttcttacagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggtggattacctgaggtcaggagttcgagaccagcctggccaacacggtgaaaccccgtctctactaaaaaattaaaacattaggcgggcgtggtggcgggcgcctgtagtcccagctactcgggaggctaaggtgtgaacctgggaggcggagcttgtagtgagccgagatcacgtcactgcactccagcctgggcaacagagcgagactccgtctcaaaaaaaaaaaaa

SEQ ID NO: 9226 - DNA, 3603 bp, Homo sapiens
ccagaggtgactttctggtgttacgtattctaggaggtactgagaccagaatatttaaggcaccagagaaggagaagagagaggagtagatcagaatctgacccatgttacgtgtttatttcagtattcattgaacgaaaagaagctgctggaattgagaacagaaatagtggcattggtaagaaacaagactgtgatttttctttgtctttgtactcatctttgcttcgttccatgcatggttgtttgtaatgataataggaagttacatgcaggtttactgtcatgggaattttttacattgtgctaaaatacacacaacataaaaattaggatcttaaccattttttaagtgtacagttcagtacatttaaagtacattcacattttggggcaaccatcgccactggctatcacagaactctttattttgcaaaattgaaactctgcaccctttatacattcccttttccagcctctggtgacctccattctactgtctatggatttgactattctacatacctcatataaatagaatcatagcatttgtctttttgtggctggcttatttcacttaacacagtgtcctgaaggttcatccatgttgttgaaatgacaggactttcttcctttttaaggctgattagtattccattatatgtatatgccacattttctttattcgtctgtcaagggcacttgtgttgcttccacccgttggcctttgtgaatagtgctgctgtgggcatgggtgcacagatgtctgttgggatccctgctttcagttcttttgggtatatatgcagaagtggagtgtcacaggattttttgcacttcacaaagtgtttggttatcgtaatggaagatagttatcctatgaaagatttaaactttcttaatgaaagtttccttttcttctttctttttttttttttttttttttgaggtggggtctcgctctgtcacccaggctggagtgcagtggctcaatctcagctcactgcaccctccttcacctcagcctgtagagtagctgggaccacaggctcacaccaccatgccctacttgagagtttgtttttcttaacggaagttttattaagaaagtttaaatctcagtaattgaagaatagtgaggaatggagaagtcttattctatttttaatttatagcatacatttctccttttccatactgtatggaacctgggacctctgaaacccccaagaggctttcatgagagaattccagaatcctgggatatttctctggaatacttttttacgcatccaggcatttatttctttttttctctgcctgaattggtagccatagggaaagatttagttgctgtaggagttttagtgaaggattcccatggtttttatgctttaatgcagttctacaaccccctatagcgtcggccaaacccactgcctttttgagggttgattatgtgtccagtttaactgtattgtatttggggaaggacacaaattggccgtgggtagccaagcctcatagtaatgaaacacttgatatttgaacatgaaagaagaaagttttttaaaaatatgactagaaatagctcaagacaagcactgccgctttcacattatctaagactccatttcttgaaaacatttttgagtttactgtctatctttgactaaggaggatttagaaggatgagacgtagccgttgcctttgagaacagactggcctcataataccacatcatttgtatagcaacctagagcttacaaatgctttttcacatagattatcgcatttgattctctaaacagtccaggtaaaggcagggcactggcttggttgtttcgttttgttctgttttcattttttcaaatagaagaaaactaaggcctagagaggttaagggtcctgaccaatgcagcgtagaattagggttttagaactgagactaaagcccaggcctccatagtcttacccaggtttccctgtgactgcaccccgttgggaaggagctataggatggtgagcagaggggacgtgctgtggtctaacgctgtgactctcttcattttaaaagcatgcccagcaagatcgggcccttacccagacagacaggaagatcgaaactgaggttgctggcctcaaaaccatgcttgagtcacacaagcttgataatattaaatatttagcaggtaagctattttgtatctatttaaatcaacctgaaaagaaaataaatttataaaataagtcgttgacagatactgcatttcattgattccaacactttctgaaatattttaacatctctgaaattggaaagcatcttacaatttccagtagatgaagtatcatagtttaattggcactttttctttcttagtagtaaataaagtaattgtgtacgttataattgatagaattggaaatttgataagatactataattgaactatagttattagggattttaatgagattcaagacaggaaatattttatggataaaatggaaggtgtttcagttgtaatctttctgcttcaattgcttaaactccttttaaggagttattttactttcgcgatttttgatccaaaagagagaatgaacattcatgtaccaccccccacccaaattaaccattatttcaagtcagatttaacgtcttggattaattaaatattttaaggttacagcattatttaacagtgaaatgttgttctttatattaaattgtgtcttcctgtctctatagtgcatatacatagaccttgtgaccacagaatttttgctattcgaaacttttattgaaaagttttcttagcctaggcaacacagcgagacctagtctctacaaaaagatttagccgggcatggtgtcatctgcctgtagcttcagcttcttgggaggctgaggcaggagggtcacttgagcccgggagtttgaggcacagtgagctgtaatcataccattgcatggtgcactcctcctgggtaccagatgagaccatgtctctaaaataagaaaataaaataaagggtgtgggatttgttttttcagtaggcaggcgtttcacggaatatgggacatcagtgagcaatctaagtttctaggttttcttttttaggttttcttaaaaaaagatgttccctcaagtaactcttaatagaactaatagtactctcaattgtttttttcttacagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggtggattacctgaggtcaggagttcgagaccagcctggccaacacggtgaaaccccgtctctactaaaaaattaaaacattaggcgggcgtggtggcgggcgcctgtagtcccagctactcgggaggctaaggtgtgaacctgggaggcggagcttgtagtgagccgagatcacgtcactgcactccagcctgggcaacagagcgagactccgtctcaaaaaaaaaaaaa

SEQ ID NO: 9227 - DNA, 403 bp, Homo sapiens; identical to SEQ ID NO: 9224

SEQ ID NO: 9228 - DNA, 1944 bp, Homo sapiens
ccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaaggtgaggccgggcgggaagggcgccccggaggggaggaaaggggtgcccgggtgggggtgccgcagggacggattccgggggagcaggccacaagcccacccaccagcccactgtgcctgcccagcagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 9229 - DNA, 252 bp, Homo sapiens
atatatatatatatacacacattaggaaagatggactaactacaacccaagtagagaaagtatgaacaaggcctgctggacagttatacaaccttgcactcaacaactgttctcttcaatcacatggaacgtgtgcaaaaactgcccatatactgggccataaagcaaatttcaaaggactgaaattatgccaagtatattgtctgactccaaggcaattatactagaaaaaaatgactagaaaaatcccca

SEQ ID NO: 9230 - DNA, 277 bp, Homo sapiens
cacaaggtgaaagacctttatggacatgacagagaggacctgagttaagagggaaaatacatcttcatagctaggttcacattcagttatgttagtcccaaacctacaaattcaacatgatccctattaaaatcctaccaatatagttcaaaagcttgacaagttgattgtgacatttatatgagagaataattaaaaaaaaaaaaaatagggccaggtgcagtggctcacgcctgttatcccagcactttaggaggccaaggcggacagatcactt

SEQ ID NO: 9231 - DNA, 2552 bp, Homo sapiens
gaattagattccatttttgaagaagaaattcagtggggattacataaatgacaaaatgtatagtttgactaagggtctaagttttactgtcctcagatgaagagcataatgggatgcagaattttatttgaattaaaatgctggtgcattttatgagggaaaaacatcaataaaagagcattaggggtaccttggctctgtgattaggagacatacttctaaataagaacattatttatcaaggctggtaacataacaagaagaatgctggaatatggtttattgctcttggttattttggtcctttttccctcatttccttaaacttatcttcaatttcaaacaaacaggaaaccttgttagagggcaatgtaatatgccacagattgaagcgtatacgagtacttgttactttcgtcacttaatcatatataacgtatgtatgtttgtatttacacctttattacatataggttgttattgggctatcctgtctaataataagctattaagtagaccaatttaaacaagagtatatttcaggagtttattttgtgttagaaaaaaacatgatatcctgatgattctactttagttattcatcttcctcttctttttttttttttcttgagatggattccaaaacctgcctcaggaaggagccatgctgctagtgtctctaaagtggtttcttatcccctgcagcatctgccaaggttctgtttggctgaggatctatgaggcatctgaagctcctgtgttttgtctacaaaaatatataggtcagatcaaaatgtaaaatatgtatttttttaattggaaaaaaaaagagaggcttctgtaacatccgaaaggccatctgagccctatctctgagcttcggttttctcatctgggtgagggcagtggccctgcaaggtcccccacctcacaggacagctgtgaggaccgcacagaagttctttgaaagctggaaggcaccaggataacatggtgtgtgttcttggcagggagggtgtttctgcaaaagcatatttttaacatgcaatttatgaaaaaatttaatatgactgacagaaggacaattttatgaaagtaaatatccatacttctcaatagactattaaaactgtagcactgggttagaattttgtctcatttgattgtagggatgatgataccaaaatctatatgttgtaatattaactcaattctcaattatattctttggctgtcttgtgtggttcaagttcagctctctgcttccgtgtggaatgccaacattttataaaaatatacaactgtaacatttttaacacaaataaaaaatgaggtagtaatgttatggcattataacagtaaattgccttggctgattaaatattagccctactaaattgtaagtgcttataaaacacaattttttaagttaaaatatattctaatttaaatcgcaaccttggtgagtcaactctaggtcctgagaaactatgtttactatctgtaatttctgaaccttcattgcatcctaataattttgatttatatgttcatgtatatgtgaaattacagtgttaaagtgtgtgcttatgatagctgctcagagtaaaagtgataaaaacttattgaatattagtataaaaactcacagaatcctgtagagactacatagattcatagatttacctgtttaaattttaaagctaaatctaattatattaagcatcagaagaattagaaaatatatataaagcaaaaaatatttgttgaatctttaactttatttgtagtattttcttaccatcaagaaattacaatggtcacatacttagtaactgccacataaatactgtttgcttgtaaatacgtgaacttccccctctgaatttttagcatagaaatacaacataaactacatgggttggccacatactcctggaatctggaaatatgtgagaggaaaatttgataaattattttatgcaagcaaaacaaaagcgctggttgctccagaatactttagatgtcgcgaaaggagcaaagaatgttctgtcaatttgtaggaccataattttgcaatcttttataaggaaaaatgttgcaatgagatataatgtttgtgtgaataaagtagtgaatgtttgtttatatttcgacagcataagaagtatataataacctaacgcacagatacacatgaatgaaaggctcttttacgttatatttaagatggggaactcatagaagtagcttacagtgaatccttctgaaggctttattgagtactgtgtaaaaactcttgtaaaaatatagaaagattaactgtagaactacaatgagttttgccctttcgccttgcttatatggagatttatttgtcattgggattctatttctaaagctggcactttgctactaaaatgggatattacaaacatatttttaaatttaatatcaaagcctgttaattctcatgagactcttaaaattattttctcttgacatttaaagagcaagcacaccaaatatactgaagtatgttaaaatacaaa

SEQ ID NO: 9232 - DNA, 856 bp, Homo sapiens
gttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtc

SEQ ID NO: 9233 - DNA, 4411 bp, Homo sapiens
ctcaggttcctggcatgacttcagggccatggcctggtggctgggacacacttacacagaggtactgaacactctgttccaagagaatctgtccactgccccctccttccacccccaagggaactttgacctgggcccaagccctgggcaggccagtgaccaggccttgtctttcctccacagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagcagtcatgtgtgtctggtctctgttttgagtcttactgaggttggcaccccttctgtgacacatcctgtcctaaaggatttgggcccttcccagcctctcaagtgcccaggccctcaggtgccttcttcaaggacctttgaaactgtgtatttgtaagaccccaaagaggacaggtacttaaacctcagttctctcttgaaacggctttcttcttatacaaggaaaaagtagcaaattcaactaaagagcctgggcacagtggctcacgcctataatctcagcacgttgggaggctgaggcaggtggatcccttgagctcaggagttcgagaacagcctgggcaacatggcaaaaccccatctctacaaaaaatacaaaaattagctgggcatgggggcgcattcctgtggtcccagctattcaggaggctgaggtgggaggatcactcgagcccaggaggtcaaggctgcagtgagttgagatcataccactgcactccggtctgggtgacagagtgagaccctgtctcaaaaaaaaaaaaaaaaaaaattcaactaaataaaggtgggccacaggaacttttccccacaaaaataaggtattaagaatacatttcagagccaggtgcagtggctcaccctgtaatcccagcactttgggaggccaaggcaggcagatcacctgaggtcaggagtttgagaccagcctagccaacatggtgaaaccccgtctctactaaa

SEQ ID NO: 9234 - DNA, 184 bp, Homo sapiens
ctcttttttttttttttttttttgagacagagtctcgctctgttgcccaggctggagtgcagtggcgcgatctcggctcactgcaagctcggcctcccgggttcacgccattctcctgcctcagcctcctgagtagctgggactaaggtgcgtgccaccacgcctggctagttgttgtattttt

SEQ ID NO: 9235 - DNA, 1078 bp, Homo sapiens
gttcttcctactttcaaattttaattattctagtttcttttaaagactcgttctctgaaatgttttatattttgtttatttgtttaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaagaaa

SEQ ID NO: 9236 - DNA, 1078 bp, Homo sapiens; identical to SEQ ID NO: 9235

SEQ ID NO: 9237 - DNA, 521 bp, Homo sapiens
gcttttatttgtagatgagacatttatgtgattgagtgaattagccattagacattttcattctagctctacagctgcaaagagggagggggaagatgtcttgagtcttgttcccaatttatcactaagtgcatcagaaatctgtcttccaacacccttggaaagaacagggtggtttttagatgtttgtgctcagacagcgggcaacagcagattaaataacaaggcaaaaatactaggaatgctggtagaaatctatgaccgcaggttaaaaaaaaagaccactcaagtaggccagacccaggagacctgggaatctagaacctggtaagcagtctggaattgggaaaggagaaaatctacttttggacccaggcattagaccgcttaagagaatctatcagtccaggtgatgagtgtgtggctgcaggccagcaggctgtggaatggcaagcagataccttttatatatttcttttaaaatatcagttaaaaaaaggctatttatattccataaaact

SEQ ID NO: 9238 - DNA, 521 bp, Homo sapiens; identical to SEQ ID NO: 9237

SEQ ID NO: 9239 - DNA, 844 bp, Homo sapiens
atttttaacaaagtggtccaagggaaaaataatgttttaagtttttatgtgcggattccagacaagcattctttctttttgttcttcctgcactctcctacatttctatgttgttactagacagtgatgtctggttctgacttatttatgtattttttttctatttgtttctggcaatgcacataataagaaatacacatagccaatattcttgctgttgttcataaccgctgagaaaaaaaagcagcatctagtaggaataaaagaagcctcagccccagaatggcaagaatcgttatatgttttttagggccactctttgcacctcgttttacagacaggttactacttatcagcttactgaccttgggaagaccccaacctctgagctaccacttcctcatctgtaacctgaggatccagtgaagtcatgtaagacaatgtagcattgtacgcttatgactagaccccagtcatgacatgagctgcttctgtctagaaaatagagggctggcagggcacgttggctcacgactgtaatctcagcactttgggaggccgaggcaggcggatcatgaggtcaggagttcaagaccggcctggccgacatggtgaaaccctgtctctactaaaaatacaaaaattagctgtgtgtgatggtgcgcgcctgtaatcccagctactgaggaggctgagccaggagaatcgcttgaacctaggaggcggagattgcagtgagccaagatcgcatcactgcgctccagcctggagacagagcgagactccatctaaaaaaaaaaaaagaaaaaagaaaaagaaaagaaaagaaaaatgaaagaaaaag

SEQ ID NO: 9240 - DNA, 105 bp, Homo sapiens
cacgcctgtaatcccagcactttgggaggctgaggcaggtggatcacgaggtcaggagatcgagaccagcctggctaacaccgtgaacctcgtctccactaaaaa

SEQ ID NO: 9241 - DNA, 281 bp, Homo sapiens
caatcataacactggatgtattaacgcatgtcaagactctcacttctctgtagaaatgagaaataaatgtcgattgttggttttctgtagacttgtgatcacgcccaggaactgtcattttccagttaccagaatctgaatcattgtctaatgtgccacgtatataacaatatatcactaacagcgatctaaaagcgtaaagatgtttacgtaaaattcatagatttgatgaaaataataggaatgaatgaaaataaatacaagaatctggatttctaaaa

SEQ ID NO: 9242 - DNA, 664 bp, Homo sapiens
tcagcctcccaagtagctgggattaaaaagccagctagctttaagatacagtgttgggcatcacattttggcacggagcaggcactcttttctttgcccccaggtgggactaagccaccacaagccttccctggtgtgtgcagtaggtaatgaatgcttgcctgctcagcacccactacatgctgggctgggtcacattactctgactcccccttgagcttcagtccatgcctggttcaagatgtattgactcaactcgaggatccggaggtgggatgtggctctggcctggccagaggaccgaggatgctgcatgccatggctacagcaaccggttcagctttgggctcatgtcctagtcagagccaatgagatgtaatcttgggatatctgctgggctgttcggaggggacaggctgccctgctcatccccattcctgatgctgagggatctgagaaaatcacttgtaaaattcggggctgtttggaagaaggggagactgatgtctccttctctctacagacatctgctcagctacagagcttgactgacctacccagaggcagaatgatatggtggttaaaagtgtgctatgggccgagatcttgccattgcactccagcctgggtgacagagtgtgactccgtctcaaaaaaaaagaaa

SEQ ID NO: 9243 - DNA, 672 bp, Homo sapiens
tcagccttccaagtagcagggattacaaagccagctagctttaagatacggtgttgggcatcacgttttggcatggagcaggcactcttttctttgcccccaggtgggactaagccaccacaagccttccctggtgtgtgcagtgggtgatgaatgcttgcctgctcagcacccacttcctggtgggctgggtcacattactatgactcccccttgagcttcagtccgcgcctggttggagattattgactcaacccggggatccagaggtgggatgtagctctggcctggccagaggaccgaggatgctgcatgccatggctacagctactggttcagctttgggctcatgtcctagtcagagccaatgagatgtaatcttgggatatctgctgggctgttgggaaggggacaggctgccctgcacatccccattcctgatgctgagggatctgagaaaatcacttgtaaaatttgggggtgtttggaagaaggggagattgatgtctctttctctctacagacatctgatcagctacagagcttgactaacctacccagaggcagaatgatatggtggttaaaagtgtgctctgggccgagattttgccactgcacttcagcctgggtgacagagtgagactccatctcaaaaaaaaaaaaaaaaaaaaa

SEQ ID NO: 9244 - DNA, 666 bp, Homo sapiens
tcagcctccaagtagctgggattacaaagccagctagctttaagatacagtgttgggcatcacattttggcacggagcaggcactcttttctttgccctcaggtgggacttagccaccacaagccttccctggtgtgtgcagtgggtgatgaatgcttgcctgctcagcacccactacatggtgggctgggtcacattactctgactcccccttgagcttcagtccgtgcctggttcaagatgtattgactcaactcgaggatccagaggtgggatgtggctctggcctggccagaggaccgaagatgctgcatgccatggctacagcaactggttcagctttgggctcatgtcctagtcagagccaatgagatgtaatcttgggatatctgctgggctgttgggaaggggacaggctgccctgctcatccccattcctgatgctgagggatctgaaaaaatcacttgtaaaattcgggggtgtttggaagatggggagactgatgtctccttctctctacagacatctgatcagctacagagcttgactgacctacccagaggcagaatgatatggtggttaaaagtgtgccctgggccgagatcttgccactgcactccagcctgggtgacagagtgagactccgtctcaaaagaaaaaaaaaa

SEQ ID NO: 9245 - DNA, 632 bp, Homo sapiens
aaagccagctagctttaagatacggtgttgggcatcacattgtggcatggagcaggcactcttttctttgcccccaggtgggactaagccaccacaagccttccctggtgtgtgcagtgggtgatgaatgcttgcctgctcagcacccacttcctggtcggctgggtcacattactctgactcctccttgagcttcagtccgcgcctggttcaagattattgactcaacgcgaggatccagagatgggatgtagctctggcctggccagaggaccgaggatgctgcatgccatggctacagcaactgggtcagctttgggctcatgtcctagtcagagccaatgagatgtaatcttgggatatctgctgggctgttcggaggggacaggctgccctgcacatccccattcctgatgctgagggatctgagaaaatcacttgtaaaatttgggggtgtttggaagaaggggagattgatgtctctttctctctacagacatctgatcagctacagagcttgactaacctacccagagacagaatgatatggtggttaaaagtgtgctctgggccgagattttgccactgcacttcagcctgggtgacagagtgagactccatctcaaaaaaaa

SEQ ID NO: 9246 - DNA, 669 bp, Homo sapiens
  misc_feature (110)..(110): n equals a,t,g, or c
tcagcctcccaagtagctgggattacaaagccagctagctttaagatacagtgttgggcatcacattttggcaaggagcaggcactctttcctttgcccccaggtgggantaagccaccacaagccttccttggtgtgtgcagtgggtgatgaatgcttgcctgctcagcacccactacatggtgggctgggtcacattactctgactcccccttgagcttcagtccatgcctggttcaagatgtattggctcaactcgaggatccagaggtgggatgtggctctggcctggccagaggactgaggatgctgcatgccatggctacagcaaccggttcagctttgggctcatgtcctagtcagagccaatgagatgtaatcttgggatatctgctgggctgttgggaagaggacaggctgcactgctcatccccattcctgatgctgagggatctgagaaaatcacttgtgaaatttgggtgtgtttggaagaaggggagactgatgtctccttctctctacagacatctgatcagctacagagcttgattgacatacccagaggcggaatgatatggtggttaaaagtgtgctctgggccgagatcttgccactgcactccagcctgggtgacagagtgagactccgtctcaaaaaaaaaaaataaaa

SEQ ID NO: 9247 - DNA, 674 bp, Homo sapiens
tcagccttccaagtagcagggattacaaagccagctagctttaagatacggtgttgggcatcacgttttggcatggagcaggcagtcttttctttgcccccaggtgggactaagccaccacaagccttccctggtgtgtgcagtgggtgatgaatgcttgcctgctcagcacccacttcctggtgggctgggtcacattactatgactcccccttgagcttcagtccgcgcctggttggagattattgactcaacccggggatccagaggtgggatgtagctctggcctggccagaggaccgaggatgctgcatgccatggctacagctactggttcagctttgggctcatgtcctagtcagagccaatgagatgtaatcttgggatatctgctgggctgttgggaaggggacaggctgccctgcacatccccattcctgatgctgagggatctgagaaaatcacttgtaaaatttgggggtgtttggaagaaggggagattgatgtctctttctctctacagacatctgatcagctacagagcttgactaacctacccagaggcagaatgatatggtggttaaaagtgtgctctgggccgagattttgccactgcacttcagcctgggtgacagagtgagactccatctcaaaaaaaaaaaaaaaaaaaaaaa

SEQ ID NO: 9248 - DNA, 726 bp, Homo sapiens
cctctggcttctgcctcctgggaggtactaaggatggatgtgaaatgtgtctgcagaccccagagttggggactgcagacggaaattgagatcagggccccagtctggcagaaatgggtgcagcatggggcattgggttccttccatcaaaggcatggggtgtgttgcagacagtcatgagatgtggctgaatcttgcaagggagccgcggtcctagggttgctgcttgagacaaagactgctgtcagtggaacctggtgaccttcacccttctgtgtcaggctgcagacagcaagagatggcagcagattacacccaacaggaaaagggccattgccatcccacaggttgccataggaggagatgacatctctccctctcctcctccagcagtgtcagctggggaagaggtgggtgggtttgcacaaaagagtagaccacagaccatgctccttctcctccagtctgctggggccccaagagagtctgcagcccttggccagggaccagctgacacaggagaacaaaagaccttaggttgggataacatggtggtgcagttcatcctctggagctccctgtgagatcagactggagctggtgtccagctgagaccacatctcactcagatccttccctgccatatcctgtttcccttactcctatctcctgagagttcttcctgaatgaattacatgcatttaatccctgcctcaggctctgctt

SEQ ID NO: 9249 - DNA, 336 bp, Homo sapiens
ttttttttttgagacacagtgtcactctctcacctaggctggagtgcagtggcacgatctcagctcactgcaacttctgactcctgggttcaagcaattctcgtgcctcagcctcccaagtagctgggattatagacacgtgccactatgcccagctaagttttgtgtttttagttgagatagagttttgtcgtgttggccaggctggtttcgaacccctgggctgaagtgatccacctgccttggcctcccaaagtgctgggattacatgtgtgagccactgtgcctagccctaatttttttttttttttttttttttttagtgtttgtagagat

SEQ ID NO: 9250 - DNA, 726 bp, Homo sapiens
cctctggcttctgcctcctgggaggtataaggagggatctgaaatctgtctgcagaccccagagttggggactgcagagggaaattgagatcagggactctagtctggcagaaatgagtgctgcatggggcattgggttccttccatcagaggcatggggtgtgttgcagacagtcatgaaatgtggctgaatcttgcaagggaccctcggtcctatggttgctgcttgagacaaagacccctgtcagtggaacctggtgacattcacccttctgtgtcaggctgcagacagcaggagatggcagcagattacacccaacaggaaaagggccattgccaccccacaggttgccatagaaggagatgacatctctccctcttctcctccagcagtgtcagctggggaagtggtgggtggatgtgcacaaaagagtagaccacagagcatgctccttctcctccggtctgctggggccccaagagagtctgcagcccttggccaaggaccggctgacacaggagaacaaaagaccttaggctgggataacatggtggtgcagttcatcctctggagctccctgtgagatcagactggagccagtctccagctgagaccacatctcacttagctcctttcctgccatatcctgttttccttactcctatctcctgagacttcttcctgaatgaattacatgcactcaatccctgcctcagtctctgctt

SEQ ID NO: 9251 - DNA, 438 bp, Homo sapiens
ttgtatttttagtagagctggggtgtcacgatgttggccaggctggtctcaaactcctgacctcaggttatacacttgcctcagcctcccaaagtgctaggattataggcgtgaaccaccgtgcctggctgtgcactaatgtttgatttttgcagaaccacccttccctaatggttgtctcctagatctaaggtgactttattcattttagaatgaacttaccccattgatactgtaaccagagttggcatacatcacgattggcagaacccggtcatgtttagcgatatggaagtgttctggaaactcctccttcttgtagacgtggaggtgacggtgcgcattcttcagtgcctggtaaagggcttcctcttgccccaacttgggcaggggcatccaaaagcaaccgtgcgcacaatattaaacttggaccaggtc

SEQ ID NO: 9252 - DNA, 545 bp, Homo sapiens
cctctggcttctgcctcctgggaggtactaaggatggatctgaaatgtgtctgcagaccccagagttggggactgcagagggaaattgagatcagggaccccagtctggcagaaatgggtgcagcatggggcattgggttccttccatcagaggcatggggtgtgttgcagacagtcatgagatgtggctgaatcttgcaagggagctgcagtcctagggttgctgcttgagacaatgaccgctgtcagtggaacctggtgaccttcacccttctctgtcaggctgcagacagcaagagatggcaggaggttacacccaacaggaaaagggccattgctatcccacaggttgccataggaggagatgacatctcttccctctcctcctccagcagtgtcagctggggaagaggtgggtgggggtgcacaaaagagtagaccacagaccatgctccttctcctccagtctgctggggccccaagagagtctgcagcccttggccagggaccggctgatacaggagaacaaaagatctcagtctggg

SEQ ID NO: 9253 - DNA, 637 bp, Homo sapiens
ttgtatttctagtagagatggggtttcaccatgttggccaggcttgtctcaaactcctgacctcaggtgatacacctgcctcagcctcccaaagtgctgggattataggcgtgagccaccgtgcccggctgtgctcttatgtttgatttttgcagaaccacccttccctaatggatgtctcctagatccaaggtgactttattcattttagaatgaacttaccccattgatactgtaaccaaagttggcatacatcacgattggcagaacccggtcatgtttagcgagatggaagtgttctggaaacccctccttcttgtagatgtggaggtgagggtacgcattcttcagtgcctggtaaagggcttcctcttgccccaatttgggcaggggcatcccaaagccaccgtagcccacaatatcaaacttgaccaagtccataaacttgatgtagttggacaagggatcttgttgacattgggtctcttcttcacggtggtcatcccatggtctcatgtgatgatgacgctgaggtgttctgcaggctgtgcttctcagtggctcccaccagatacctgatggtcctgtcgatttgctgaatcatcaacttcctattctctgcctctggcctgaatcg

SEQ ID NO: 9254 - DNA, 638 bp, Homo sapiens
ttgtatttttagtagagatggggtttcaccatgttggccaggctggtctcaaactcctgacctcaggtgatacacctgcctcagcctcccaaagtgctgggattatgcgcatgagccaccgtgcctggctgtgcacttatgtttgatttttgcagaaccacccttccctaatggttgtctcctagatccaaggtgactttattcattttagaatgaacttaccccattgatagtgtaaccagagttggcatacatcacgattggcagaacccggtcatgtttagcgatatggaagtgttctggaaactcctccttcttgtagatgtggaggtgagggtacgcattcttcagtgcctggtaaagggcttcttcttgccccgatttgggcaggggcatcccaaagccaccatagcccacaatatcaaacttgacccagtccctgaacttgatgtagttggacaaggggatcttgttgacattgggtctcttcttctcggtggtcaccccatggtctcgtgtgatgatgacgctgaggtgctctgcaggctgtgcttctcagtggctccctccagatacccgatggtcctgccgatttgctgaatcatcaacttcctgttctctgcctctggcccgaatcg

SEQ ID NO: 9255 - DNA, 730 bp, Homo sapiens
cctctggcttctgcctcctgggaggtacaaaggagggatctgaaatgtgtctgcagaccccagagttggggactgcagagggaaattgagatcagggactgtagtctggcagaaatgagtgcagcatggggcattgtgttccttccatcagaggcatgggggtgtgttgcagacagtcatgaaaatgtgactgaatcttgcaagggaccctcggtcctagggttgccgcttgagacaaagacccctatcagtggaaccctggtgaccttcacccttctctgtcaggctgcagacagcaagagatggcagcagattacacccagcaggaaaagggcggtttttatcccacaggttgccataggaggagatgacatctctccctctcctcctccagcagtgtcagctggggaagaggtgggtgggtgtgcacaaaagagtagaccacagagcatgctccttctcctccagtctgctggggcccccagagagtctgcagcccttggccagggaccggctgacacaggagaacaaaagaccttaggttgggataacatggtggtgcagttgatcctctggagctccctgtgagatcagactggagccagtctcctgctgagaccacatctcacttagctcgttccctgccatatcctgttttccttactcctatctcctgagagttcttcctgaatgaattacatgcactcaatccctgcctcaggctctgctt

SEQ ID NO: 9256 - DNA, 727 bp, Homo sapiens
cctctggcttctgcctcctgggaggtaataaggatggatctgaaatgtgtctgcagaccccagagttggggactgcagagggaaattgagatcagggaccccagtctggaagaaatgggtgcagcatggggcactgcgttccttccatcagaggcatggggcgtcttgcagacagtcatgaaatgtggctgaatcttgcaagggaccctcggtcctagggttgctgcttgagacaaagacccctatcagtggaacctggtgaccttcacccttctgtgtcaggctgcagacagcaagagatggcagcagattacacccaacaggaaaagggccattgctatcccacaggttgccataggaggagatgacatttctccctctcctcctccagcagtgtcagctggggaagaggtgggtgggtatgcacaaaagagtagaccgcagaccatgttccttctcctccagtctgctggggccccaagagagtctgcagcccttggccagggaccggctgacacaggagaacaaaagaccttaggctgggataatatggtggtgcagttcatcctctggagctccctgtgagatcagactggagctggtgtccagctgagaccacatctcacttagctccttccctgtcatatcctgttttccttactcctatctcctgagagttcttcctgaatgaattacatgcactcaatccctgcctcaggttctgctt

SEQ ID NO: 9257 - DNA, 637 bp, Homo sapiens
ttgtatttttagtagagatggggcttcaccatgttggccaggctggtctcaaactcctgacctcaagtgatacacctgcctcagcctcccaaagtgctgggattataggcgtgagccaccgtgcctggctgtgcactcatgtttgatttttgcagaaccacccttccctaatggttttctcctagatccaaggtgactttattcattttagaatgaacttatcccattgatactgaaactagagttggcatacatcacgattggcagaacttggtcatgtttagcgagatggaagtgttctggaaactcctccttcttgtagacgtggaggtgagggtgcgcattcttcagtgcctggtaaagggcttccgcttgccccaatttgggtaggggcagcccaaagccaccgtagcccacaatatcaaacttgaccaagtctctgaacttgatgtagttggacaagggatcttgttgacattgggtctcttcttcacggtggtcatcccatggtctcatgtgatgatgacgctgaggtgctctgcaggctgtgcttctcagtggctcccaccagatacccgatggtcctgtcgagttgctgaatcatcaacttcctgttctctgcctctggcctgaatcg

SEQ ID NO: 9258 - DNA, 638 bp, Homo sapiens
ttgtatttttagtagagctggggtgtcaccatgttggccaggctggtctcaaactcctgacctcaggttatacacttgcctcagcctcccaaagtgctaggattataggcgtgaaccaccgtgcctggctgtgcactaatgtttgatttttgcagaaccacccttccctaatggttgtctcctagatctaaggtgactttattcattttagaatgaacttaccccattgatactgtaaccagagttggcatacatcacgattggcagaacccggtcatgtttagcgatatggaagtgttctggaaactcctccttcttgtagacgtggaggtgacggtgcgcattcttcagtgcctggtaaagggcttcctcttgccccaacttgggcaggggcatcccaaagccaccgtagcgcacaatatcaaacttgaccaggtccctgaacttgacgtagttggacaaggggatcttgttgacattgggtctcttctttacggtggtcatcccacggtctcatgtagtgatgacgctgaggtgctctgcaggctgtgcttctcagtggctcccaccagatacccgatggtcctgtcgatttgctgaatcatcaacttccttttctctgcctctggcccgaatcg

SEQ ID NO: 9259 - DNA, 726 bp, Homo sapiens
cctctggcttctgcctcctgggaggtataaggagggatctgaaatctgtctgcagaccccagagttggggactgcagagggaaattgagatcagggactgtagtctggcagaaatgagtgctgcatggggcattgggttccttccatcagaggcatggggtgtgttgcagacagtcatgaaatgtggctgaatcttgcaagggaccctcggtcctatggttgctgcttgagacaaagacccctgtcagtggaacctggtgacattcacccttctgtgtcaggctgcagacagcaggagatggcagcagattacacccaacaggaaaagggccattgccaccccacaggttgccatagaaggagatgacatctctccctctcctcctccagcagtgtcagctggggaagtggtgggtggatgtgcacaaaagagtagaccacagagcatgctccttctcctccggtctgctggggccccaagagagtctgcagcccttggccaaggaccggctgacacaggagaacaaaagaccttaggctgggataacatggtggtgcagttcatcctctggagctccctgtgagatcagactggagccagtctccagctgagaccacatctcacttagctcctttcctgccatatcctgttttccttactcctatctcctgagacttcttcctgaatgaattacatgcactcaatccctgcctcagtctctgctt

SEQ ID NO: 9260 - DNA, 2257 bp, Homo sapiens
ctggttcttaaaatgccctttttctcctgcctttaggagctctgtgatcatatcgagctcatctgggttaatttatttatattcacaatatccatggagtacatatggcatcttgtgggcctttagtctgccttctatgaatataagacattatttccccagaatgaaaatgtatatgaagaaagagaaatatgccactggaaagtagttcaaataatgaaagtcttttgcttgttatagccttcctttttttctgttctttttcctttccttccataaaagatttattatatgcttttaggaaaataacaaaagcagaatgtttgctaaccatctatgggtgaaagagtagcaaatttggtttaaggagatgttgtaaataatggtatgacaattcctgggattctgggagtcacttaataaggagacagaaatagattcaatgccagtgtgcccctaatgagaaaagggaattcttttactgaggcctataatcttgggaatatgcttttaattaaaattataagtctaaaacttttactattactatgactgtttatagctcccaatttaactcacgtaacagaggagtgagtggatgggtgggctagacttaagataataagggagtaaggagtgaaagaaaaccccacctatctcctcacctgaaggccctggacacgtccagcctgctttgggagtaaggcaacaggagattgaaatcaagttggcagttgagttttgaactgtattagactccacagttcaatttccaagagttgtatgaaaataaaactagtaggataaaagacagacatccagtacactcattccttcttcaatgttctattttatcattatagccagtgcctgtggcaggcacactctgagatgggccacagtgttctgtctcccggaatccatacccttgtgtaatcgttaccacttcagtgtaggctggatctagtgactctttactgaaaaatacaaaatggcagaaatgctgggatgccactgattttgttaggttatcaaaacgctgtggcttttgccttgaatttctctccatgctcattttcttactttctgtaataccttacaaaaggagaagcaagctggcataatgagagcaactttatggagaagtccgtgtgagaaggaattggtatctctagccaacagctagggagggtctgagcctgtcagaaaccaatgaatgagtttggaagcagatctgtcagcccctttcaagacttcagatggctgaaactccaactgacaccttgtctggaatctcattaagccatgaagcacgtagctaaacacattctttaccaatatgaactattaagtaataataatctattgttttaatccatgttttcaggttattatagcaatagataacaaatatgcatagtgctcaagtttaaaagggattatatgccattaaatgcacattgcaaatatgattatatggattcatttttccttataggcaatattataagcaaaagtcagattcctggacagcctagcagaatgggattacttttataaaaagatgaccaaagtgtttgcataaaatattcttcacatttcataacaccaaagcaaaagagtacttcacagctcaggggagattgtaaaatactcagatcgcttacagaaccatggggtcgttacatctctttgacttgtggtatttatttccaccaagttctttttaataaagtctgcggaagtttcccgggtaagttcaaggtgttgttctttctgtagtgcgtatttcaaaaaaaaaaaaaaaaaaaaaaaagctgacattctaagcctttccaaagaattcttcttctctttttttgttttatagagataagaaaaatcaaatattgtatttcaattaaagatacaaatcatttaaaagatcagccatttattaatgaacaaatacgttgtcaaagaggtgacaagcaatggtttcagtgattttattttattttcacttcaaattgcttattccagctctaaccacctacattattattatgagctgctgttaactgaacctctattttattcctctttgtccaagagctctacaaacactctctataatccttaaaataactccacaaatggaagacattatttccatttcacagatgaggaaacaaactcggagttatcaggtagttgtctgcctatgaaatggaagaaaaggcatttgaattcaagtttacctagtcctaaaactaga

SEQ ID NO: 9261 - DNA, 5363 bp, Homo sapiens
taagtccttgcacaagtgggatatattttgaatattgaccatctagcttgatgtctcatacaaaaagatattttttacacagtttttaatatttccatagtttattttcaaagggactgtaatgcatattacttattaaaagcattttttcccccaactttgatggggaaaagcatatcaacagatacctacttttgtagatggctataaaaattgttacccaaaaggctttcttagagcaaattgtctcttatgattattcctgcctgcctccatgggatctgtctttatattgttggagagaatagcaaacatccataatacattttttttttttttgtggatataacattcaggatagaattgtttgtcatttattgcttagattgatattttgtatacttagggattatgaaaaaagtttgtgttaatattgcattattaaagcacatgtttaaagataattattagattttaagttcacaatgcttcatgtattgtttattcttgtgattttatttttactttaggaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaaggtttgagatgcacatcatggctttacatttcttcattatcattttattctatgagtgttattaagatgatttaattcttgggccactttgagttagagtaaaatggttttgtatcatttaatattgacatgaagttggccctctgtgtctgtgggttccatatccatcaatttgaccaacggtggattgaaaatatttggaaaaaataaaagtgtgtggttgcctctgtactatacatgtagagactttttattcttgtcataattccataaacaatatattaacaactattcatgcagcatttacatcgtatcaggtttttggtgttttttttgttttgtttttttgagactgagtcttactctgtcacccgggctggaatgcagtagcgcgatctcagttcgttgcaatctctgcctcccaagctgaagcaattctcgtgcctcagcctcctgagtagctgggattacagacatgtgccaccacacctggctactttttgtatttttagtagagatggggttttgctacgctggccaggctggtcccaaactcctggcctcaagtgatcctcctgtcttggcctcccaaagtgctgggattacaacgtgagccactgtacccggcctgtattaggtattgaaagtaatttagagatgacttcaagtgtactggagggtgtgtgtaggttatatacaaatactacaccattttatatcagagacttgagcatccatggattttgatatccttgggggttcctgaacaaattctgcatggatactgagggatatttactcagtacctgaggttttactctgacttttacattaaatgtaccttctttctgtgaaaatattacaactgtgctgttactttaatctatgtacctaagcactcttatgttcaactaatggctggagagaagaaatgatataaaacttagcccgtgtatataaataatatacaatttttagaatgtttttatgtgctactttgaaacaagttaaaatataggattgtgatgtatttatttgataattcatagaatttaaaagctttgaaggatataatacttttattttattctttcattagacaatagtcgaaaaagtccaaaatcctaccttgaaatcctggcagaagtacgagattataaaagaagacgccagtcctatagagccaagaatgttcacataaccaagaaatcatatactgaggtaagttttacataatctttgttgataagaatttcccttaggtaattttctaaatctgttctatgaatttccacaattctttggaaattttctgaaagtgtcttcagggtggccacacctgatttgtatctgttccatcacttctagatccaccctttagcaagcaaaggctttcatagtataagaaccttatataaaacaattgtacaatcttaaaagatatctccttgtgagaaagtagtagtgtatcatggtaagagcatgagtttgggtttaggtagaccataccttgacttttgattctgctgtttctcattggctctttgacttaagcaagttatttgagctttttagattgaatgttttcttttcataataataataatataatctttgcagggttgttatgagaattgactgacagaatgtatgcaaacacaaatttcttcatgaatattagctattatcttttttggcagaaagcatgtttttatgtactctagtaaatatttggacttaagaaatgtcttgatatacattatttatgtattagtctcttggtgtatgtctagacttattttcagatgccatttaatggctcgttagagttgatgaatttttttggtatgtgaattaccttgcccagactctacaaataattgcctcattgattccctaattgttcccgtattatttcttacttctctctgatttaaaagaccttccataatctggcctccttttcccaagcatttcttttgctttagtcaagcatgtctcttaaactatatctgattgcatataattattcttacctccatgccctattacctgttactttcttacctgaaatgctctgtttttgccattttaaatcttgttgagtttaagggccaccatttccatgaggtgctagttgactaatctatcactagtttattgtactaatactctgtaccacacagcttagctctaaattttatgctgttctttttacagttaaaatctgtgttttagacttaacttagcaagtagagacctgggtccctgtcatactaccttggtgattctcatagtccctaagatacttggctcatcagttatttcttctctcgtctcataacccttgtaatcaagcttaaatgttgctgctagcattctttacggttttatagttgatattttattgtggaaatattcaaacatatactaaagtggatagcatcgtctaaggaatgtacccatcacccagcttcaaaaattgaaataaaagattggcaagggcttcatagagaaaagcatttgagggaaagggagaagcaaggaggaataaaggaatgtctgctattgactcttgcctatgtggtggagcctgagctaggtggattctgtgcaaatagcaggcttcaaggcgcttacatagagctgctgacagggaggcttgtaggcctgccagggaagtgcgagagctggaacttgagataggtgtgtgtgactcatgtcactccgctaggttggaccttggcatatcttaggttttccatgggagaatatagtggaggaggagaagtggtggataaggattttccgggtggaagaactagcattctgaaaagcagatagaagtataggagtttttcagagactcattagtaacccagggtggctagagcttagggcttctctgttgagagatgaggctaagttctatcttatgtaggaaaatcctggagggctctgaaggcttcattaaggagtttggatattgttcgattttactttgagagccattgaaagtttctttaaggtggggagaaatgcagtcaggcctgaatgaatagtgtttctgagattgccccgtgtcccctataccttttttctgaaaacattttctatttaatcatgagggaagtgtaaactcctattttagttttgtctttgcctctgcagtgactaaccctgtgcttggtggcatgggtaaataggaaaggaaaaactttcaagtggtttttacctatttgaaagtttctttatagagtcattcagaaagtatctgtgaagtgactgtatgtttcatattttgtcttattaagtcatatgattaagtcaagatgacttaattataaggttttaaaaaaatcatttgtaaataagctctaatagagagataaattgcaaaactaaaaatagtaccaagaactcccatattgtctttacccagatcacccattgttagcattttgccacatagcttctcattggcactctctctctctctctctgcacatttttcactctctcgatctcgatctgtacatatttttttcccctgaattctttaagggttaaattacatacctcataaccctttatccccagtatgtatttcctaagaacagagatattttctcacataaaggtagtacagttatagcaacttcaaatttaatattgctgtaaaacttttatctactattcatattccagtttgaccattgccttttctgtgttctctaaactgcacaagtcccacagtcaattatgtcatagcacttagtaaatatttgattgttagcactgatttttctagcgttacagtcttaattttttgagcagttttcttacctgaagttcggtgcttacctctcccaaggtgattcgagatgtgataaatgtgcacatggaagaactcagcaatcattggcaagaagagcaagagaaggcagaggatgatgccgaaaagtacgtcattatctttattggtgaaaatactctctctttgataacagataacaattaacttataattgttaaattttagcatttccaaaacccttgatagcacacagtaaactcgtgaaaatgctttttgtttttcgttgtcagtgcccagggttattgtaccagagttgttctgacattaccctttgacagttttcaggggatagccatattagtgaaatattcaaatagcaaaacatactaacatttatgcctagtattccattatgggaacaccaagcatgtgggagttatttatgtcctactgctcaaggtcatcgccaaggtctcattgcaaaaattaaaaaaattgcaacctcaggcataaatgggttaagagctgtgtttatttgtccttttatatgggttataagattgtgcatatttagaccatatctaccattggtttgatatagaatattacactttagactggtgtgtctgtgtacgtatactggagaccagtggtaacacaaactgattaacattcttttctgtgttttaggaatgaagaaaggcgatcagcttcagtagattcacggcagtctggtggaagctatttggatgctgagtgttcacgacatagaagggataggagtagaagcccacataaaagaaaaagaaacaaagataaggataaaaa

SEQ ID NO: 9262 - DNA, 5341 bp, Homo sapiens
taagtccttgcacaagtgggatatattttgaatattgaccatctagcttgatgtctcatacaaaaagatattttttacacagtttttaatatttccatagtttattttcaaagggactgtaatgcatattacttattaaaagcattttttcccccaactttgatggggaaaagcatatcaacagatacctacttttgtagatggctataaaaattgttacccaaaaggctttcttagagcaaattgtctcttatgattattcctgcctgcctccatgggatctgtctttatattgttggagagaatagcaaacatccataatacattttttttttttttgtggatataacattcaggatagaattgtttgtcatttattgcttagattgatattttgtatacttagggattatgaaaaaagtttgtgttaatattgcattattaaagcacatgtttaaagataattattagattttaagttcacaatgcttcatgtattgtttattcttgtgattttatttttactttaggaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaaggtttgagatgcacatcatggctttacatttcttcattatcattttattctatgagtgttattaagatgatttaattcttgggccactttgagttagagtaaaatggttttgtatcatttaatattgacatgaagttggccctctgtgtctgtgggttccatatccatcaatttgaccaacggtggattgaaaatatttggaaaaaataaaagtgtgtggttgcctctgtactatacatgtagagactttttattcttgtcataattccataaacaatatattaacaactattcatgcagcatttacatcgtatcaggtttttggtgttttttttgttttgtttttttgagactgagtcttactctgtcacccgggctggaatgcagtagcgcgatctcagttcgttgcaatctctgcctcccaagctgaagcaattctcgtgcctcagcctcctgagtagctgggattacagacatgtgccaccacacctggctactttttgtatttttagtagagatggggttttgctacgctggccaggctggtcccaaactcctggcctcaagtgatcctcctgtcttggcctcccaaagtgctgggattacaacgtgagccactgtacccggcctgtattaggtattgaaagtaatttagagatgacttcaagtgtactggagggtgtgtgtaggttatatacaaatactacaccattttatatcagagacttgagcatccatggattttgatatccttgggggttcctgaacaaattctgcatggatactgagggatatttactcagtacctgaggttttactctgacttttacattaaatgtaccttctttctgtgaaaatattacaactgtgctgttactttaatctatgtacctaagcactcttatgttcaactaatggctggagagaagaaatgatataaaacttagcccgtgtatataaataatatacaatttttagaatgtttttatgtgctactttgaaacaagttaaaatataggattgtgatgtatttatttgataattcatagaatttaaaagctttgaaggatataatacttttattttattctttcattagacaatagtcgaaaaagtccaaaatcctaccttgaaatcctggcagaagtacgagattataaaagaagacgccagtcctatagagccaagaatgttcacataaccaagaaatcatatactgaggtaagttttacataatctttgttgataagaatttcccttaggtaattttctaaatctgttctatgaatttccacaattctttggaaattttctgaaagtgtcttcagggtggccacacctgatttgtatctgttccatcacttctagatccaccctttagcaagcaaaggctttcatagtataagaaccttatataaaacaattgtacaatcttaaaagatatctccttgtgagaaagtagtagtgtatcatggtaagagcatgagtttgggtttaggtagaccataccttgacttttgattctgctgtttctcattggctctttgacttaagcaagttatttgagctttttagattgaatgttttcttttcataataataataatataatctttgcagggttgttatgagaattgactgacagaatgtatgcaaacacaaatttcttcatgaatattagctattatcttttttggcagaaagcatgtttttatgtactctagtaaatatttggacttaagaaatgtcttgatatacattatttatgtattagtctcttggtgtatgtctagacttattttcagatgccatttaatggctcgttagagttgatgaatttttttggtatgtgaattaccttgcccagactctacaaataattgcctcattgattccctaattgttcccgtattatttcttacttctctctgatttaaaagaccttccataatctggcctccttttcccaagcatttcttttgctttagtcaagcatgtctcttaaactatatctgattgcatataattattcttacctccatgccctattacctgttactttcttacctgaaatgctctgtttttgccattttaaatcttgttgagtttaagggccaccatttccatgaggtgctagttgactaatctatcactagtttattgtactaatactctgtaccacacagcttagctctaaattttatgctgttctttttacagttaaaatctgtgttttagacttaacttagcaagtagagacctgggtccctgtcatactaccttggtgattctcatagtccctaagatacttggctcatcagttatttcttctctcgtctcataacccttgtaatcaagcttaaatgttgctgctagcattctttacggttttatagttgatattttattgtggaaatattcaaacatatactaaagtggatagcatcgtctaaggaatgtacccatcacccagcttcaaaaattgaaataaaagattggcaagggcttcatagagaaaagcatttgagggaaagggagaagcaaggaggaataaaggaatgtctgctattgactcttgcctatgtggtggagcctgagctaggtggattctgtgcaaatagcaggcttcaaggcgcttacatagagctgctgacagggaggcttgtaggcctgccagggaagtgcgagagctggaacttgagataggtgtgtgtgactcatgtcactccgctaggttggaccttggcatatcttaggttttccatgggagaatatagtggaggaggagaagtggtggataaggattttccgggtggaagaactagcattctgaaaagcagatagaagtataggagtttttcagagactcattagtaacccagggtggctagagcttagggcttctctgttgagagatgaggctaagttctatcttatgtaggaaaatcctggagggctctgaaggcttcattaaggagtttggatattgttcgattttactttgagagccattgaaagtttctttaaggtggggagaaatgcagtcaggcctgaatgaatagtgtttctgagattgccccgtgtcccctataccttttttctgaaaacattttctatttaatcatgagggaagtgtaaactcctattttagttttgtctttgcctctgcagtgactaaccctgtgcttggtggcatgggtaaataggaaaggaaaaactttcaagtggtttttacctatttgaaagtttctttatagagtcattcagaaagtatctgtgaagtgactgtatgtttcatattttgtcttattaagtcatatgattaagtcaagatgacttaattataaggttttaaaaaaatcatttgtaaataagctctaatagagagataaattgcaaaactaaaaatagtaccaagaactcccatattgtctttacccagatcacccattgttagcattttgccacatagcttctcattggcactctctctctctctctctgcacatttttcactctctcgatctcgatctgtacatatttttttcccctgaattctttaagggttaaattacatacctcataaccctttatccccagtatgtatttcctaagaacagagatattttctcacataaaggtagtacagttatagcaacttcaaatttaatattgctgtaaaacttttatctactattcatattccagtttgaccattgccttttctgtgttctctaaactgcacaagtcccacagtcaattatgtcatagcacttagtaaatatttgattgttagcactgatttttctagcgttacagtcttaattttttgagcagttttcttacctgaagttcggtgcttacctctcccaaggtgattcgagatgtgataaatgtgcacatggaagaactcagcaatcattggcaagaagagcaagagaaggcagaggatgatgccgaaaagtacgtcattatctttattggtgaaaatactctctctttgataacagataacaattaacttataattgttaaattttagcatttccaaaacccttgatagcacacagtaaactcgtgaaaatgctttttgtttttcgttgtcagtgcccagggttattgtaccagagttgttctgacattaccctttgacagttttcaggggatagccatattagtgaaatattcaaatagcaaaacatactaacatttatgcctagtattccattatgggaacaccaagcatgtgggagttatttatgtcctactgctcaaggtcatcgccaaggtctcattgcaaaaattaaaaaaattgcaacctcaggcataaatgggttaagagctgtgtttatttgtccttttatatgggttataagattgtgcatatttagaccatatctaccattggtttgatatagaatattacactttagactggtgtgtctgtgtacgtatactggagaccagtggtaacacaaactgattaacattcttttctgtgttttaggaatgaagaaaggcgatcagcttcagtagattcacggcagtctggtggaagctatttggatgctgagtgttcacgacatagaagggataggagtagaagcccacataaaagaaaaa

SEQ ID NO: 9263 - DNA, 285 bp, Homo sapiens
tgctagactgtgagctccatgaaggcaaggtctgtatcttacttagttttatacacaaagtactttcaaatattaggctctcaaataatatcctgtctctccagggccactggtaatcaggaattaaagcttattgtattggtttggtaattttgttcatcttactatcattcagttaattaggtttaaagctacctatgacttagtccttttcttatacaaatgaaatatttgcttagtaatcctttttgattcatatgctgttttataataactatagtgctt

SEQ ID NO: 9264 - DNA, 285 bp, Homo sapiens; identical to SEQ ID NO: 9263

SEQ ID NO: 9265 - DNA, 610 bp, Homo sapiens
  misc_feature (595)..(596): n equals a,t,g, or c
agatccccacctttttacccttctgcaaagtctcttgtaattcctaagtaatgaaatggaaagtacaaattacttaaaacaagctctgttctttttcttctggaaaacttgtgtagtttgtcctgtgtatctgtttctcatgaggagaccggctttctgtggcccacgtgaacactgagtaagaaacaaaagactgtggtctccaggacacagtgtgtgtttgtcctctgccatggttattcaccaagtggagtccagcagtttaggaatcgggaggtctcccatgatgagttgtcatcttctgaattgctgcaagtgacaccaaaggggcccccctaccagtttctcacttcccagtctcactactggatcagctcttaggagccaggagagttcactgctgtggctaggatagaaaagggcagctagtgccccagggtagatcttggaaaatattttttgggaaaaatgtaattaaggccacccctaaaatagatactgtatctggctgtactatactaacagtgatttgcctgcatgtgtttgatagagatttctaccatgtactgcttggtgctggatagtctatcacagnncaaaaaaaaaaaaa

SEQ ID NO: 9266 - DNA, 5684 bp, Homo sapiens
agaaaaaaactgaaggcacctatgacttaccttactgggaccgggcaggtaactcacgtggtctttgcatctcatttctatcagagggatgtcgctcccctacagggggcagtagtgaaaaaagagtcattctctggcccaggtgaactccccgacactgttagaacaatggcattactcttcagttctcaccatttttacccttctgcaaagtctcttgtaattcctaagtaatgaaatgaaaagtacaaatttcttaaaacaagctctgttctttttcttctggaaaacttgtgtagtttgtcctgtgtatctgtttctcatgaggagaccggctttctgtggcccacgtgaacactgagtaagaaacaaaagactgtggtctccaggacacagtgtgtgtttgtcctctgccatggttattcaccaagtggagtccagcagtttaggaatcgggaggtctcccatgatgagttgtcatcttctgaattgctgcaagtgacaccaaaggggcccccctaccagtttctcacttcccagtctcactactggatcagctcttaggagccaggagagttcactgctgtggctaggatagaaaagggcagctagtgccccagggtagatcttggaaaatattttttgggaaaaatgtaattaaggccacccctaaaatagatactgtatctggctgtactatactaacagtgatttgcctgcatgtgtttgatagagatttctaccatgtactgcttggtgctggatagtctatcacagcaaaaaaaaaaaaaaaagttggattataaaggcaagtttgtagagatatttgttatagaaatggcttaaatgcaacaggatttttctcttgatactactgtttgagatacaggtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcaggtaactatgttgcagccttctggtaccaggcagagggagaaactgcttaggcttgctataaagtgctttgggatttacagttctttgatccctttcatgtttaagaaatgaattgtttcctaaaggtagaaccacttttttaaaaggtgactcttcagagagtcatttctgtatcttggatattctgtctgtaaagttgggacattgatttctaaagactctgggcattatgtatgttaactgaggcttgtggggagacccgagatgttgagaggagagcgggaaagacagaagaagccttacagtgtttatcctcttagcctagtacatacttattttaaacatttcctaatatttgaaaaaaatctctgaaattatttttcaagattaatatttattccagtaactgaatgtttcttttccaatgaaatattctgaaaataattcagaaaggaaatattcagtaaagaaatatgttgtctgtaaatctaaagaacatatgtgaaaattctatatgcaaaattacatgaatgagactttctggtatattattactatgagaagtactagacagtatgtttaattttaattttcaaagttcttacagattaagtattgatggcaacaaaagtatcctaaagaatgtttgcttttagtataatctgcagctgccaccctaaattatgcaatctctttactagtaaaatgacttttctgttgttttgtgatatccacagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggcctttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttcctagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctataaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaaaagttaactgtggcaccaattctaatgtaatccaacttgtgactgtttttttttgttttgttttgtttttgtgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaa

SEQ ID NO: 9267 - DNA, 5681 bp, Homo sapiens
agaaaaaaactgaaggcacctatgacttaccttactgggaccgggcaggtaactcacgtggtctttgcatctcatttctatcagagggatgtcgctcccctacagggggcagtagtgaaaaaagagtcattctctggcccaggtgaactccccgacactgttagaacaatggcattactcttcagttctcaccatttttacccttctgcaaagtctcttgtaattcctaagtaatgaaatgaaaagtacaaatttcttaaaacaagctctgttctttttcttctggaaaacttgtgtagtttgtcctgtgtatctgtttctcatgaggagaccggctttctgtggcccacgtgaacactgagtaagaaacaaaagactgtggtctccaggacacagtgtgtgtttgtcctctgccatggttattcaccaagtggagtccagcagtttaggaatcgggaggtctcccatgatgagttgtcatcttctgaattgctgcaagtgacaccaaaggggcccccctaccagtttctcacttcccagtctcactactggatcagctcttaggagccaggagagttcactgctgtggctaggatagaaaagggcagctagtgccccagggtagatcttggaaaatattttttgggaaaaatgtaattaaggccacccctaaaatagatactgtatctggctgtactatactaacagtgatttgcctgcatgtgtttgatagagatttctaccatgtactgcttggtgctggatagtctatcacagcaaaaaaaaaaaaaaaagttggattataaaggcaagtttgtagagatatttgttatagaaatggcttaaatgcaacaggatttttctcttgatactactgtttgagatacaggtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcaggtaactatgttgcagccttctggtaccaggcagagggagaaactgcttaggcttgctataaagtgctttgggatttacagttctttgatccctttcatgtttaagaaatgaattgtttcctaaaggtagaaccacttttttaaaaggtgactcttcagagagtcatttctgtatcttggatattctgtctgtaaagttgggacattgatttctaaagactctgggcattatgtatgttaactgaggcttgtggggagacccgagatgttgagaggagagcgggaaagacagaagaagccttacagtgtttatcctcttagcctagtacatacttattttaaacatttcctaatatttgaaaaaaatctctgaaattatttttcaagattaatatttattccagtaactgaatgtttcttttccaatgaaatattctgaaaataattcagaaaggaaatattcagtaaagaaatatgttgtctgtaaatctaaagaacatatgtgaaaattctatatgcaaaattacatgaatgagactttctggtatattattactatgagaagtactagacagtatgtttaattttaattttcaaagttcttacagattaagtattgatggcaacaaaagtatcctaaagaatgtttgcttttagtataatctgcagctgccaccctaaattatgcaatctctttactagtaaaatgacttttctgttgttttgtgatatccacagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaa

SEQ ID NO: 9268 - DNA, 360 bp, Homo sapiens
tttttttaaaaaaataatttcaacttttattttagattctaagggtacatgtgcagagtgcaggttgttacatgggtatattgtgtgatactgaggtttgtggtatgaatgatcccatcatccaggttgtgagcatagtacccaatacatagtctttcagcccttgccctccccgctcccctcgctccccccgccgcagtcctcagtgtctatcgttcccatctttatgtccttgtgtacccacagcaccattctttttgaagcctgatttactttatatcaattgaacttcagcagccacactgcagcctatggctgtgtggtatgaggggaaaatcacactgattgattacatgtgat

SEQ ID NO: 9269 - DNA, 4403 bp, Homo sapiens
aaaacaatctacgaagcaggcactataataagccccgttttacagaaggagaaaatgagacacaacataaataacttgcctagttatgggcaaataacttgcctagtttatgggcataaataacctgcctagttattgcctagtacatgggcagaggggagttttggaccagacttgagagatcgtgctcttacccactgctgctctgaacacataataaataaagtataactcactgttattaaagcacagggtgtgagggggaggactgaggagtgccgctgttgagagggcagaagtcagacagagcctgaggtcagtttgggatggtgttgaaaggaccctgtggacatccagactcctgaggcaattcgaccacacacctggcgttaaggacacgatctgagctggagaattgaagttactgttaggaacgtagttgaaatcactgatgagtgtggctttatgacaaggagtaaaggagcagataccattaatatgctgtggaaaatagggaggatgagaatgataataaaaacagctgcagcttattgaatccagagctcattctaagcactttatacgtaatgaataagtaaccagaagctttgtcacttatgtgtataaaatcctttatagtacaacctatggctaatattgatgccataaatttgttgtcctagcaatatagggcatctaacttctatttagaaaagatgatttatttatttttttatttctaaatcatgtgatgattagagcattttcagggagaaaggtgtttaatcagtatttttttttatttcttttccattcaagtgtttcattaacatcttcaacactcattatcttttccacaaattttttattatgctgtactttgaaataatgaaataagtatacctacgctttaaaatgaggatgcatttagtatcaaaaatatagtcttatactggagaatgtttcccagtaggaaaagcacatggcttgggctttttatgaaaaccacatttgtggtgctcacttcggcagcacatatactaacattggaacgacacagagaagattagcatggcccctgtgcaaggatgacacgcaaattcatgaagcgttccatatttttaattgaccacatagttgaaagtaaagcactcatcagcaaatgtaacagaaaagaaattataacaaactgtctctcagaccacagttcaatcaaacaagaactcaggattaagaaactcactcaaaaccactcaactacatggaaactgaacaacctgctcctgaatgactactgggtacataatgaaatgaaggcagaaataaagattttctttgaaaccaatgagagcaaagacacaacataccagaatctctgggacacattcaaagcagtgtgtagagggaaatttatagcactaaatgcccacaagagaaagcaggaaagttctaaaattgacaccctaacatcacaattaaaagaactagagaagcaagagcaaacacattgaaaagctgcagaagtcaagaaataactaagatcagagcagaactgaaggagatagagacaaaaaacccttcaaaaaatcagtgaatccaggagctggttttttgaaaagatcaacaaaattgatagactgctagcaagactaataaagaagaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctggacacatacaccctcccaagactaaaccaggaagaagttgaatccctgaatagaccaataacaggctctgaaattgaggcaataattaatagcctaccaaccaaaaaaagtccaggaccagacggattcatagccgaattctaccagaggtacaaggaggagctggtaccattctttctgaaagtattccaatcaatagaaaaagagggaatcctccctaactcattttatgaggccagcatcatcctgataccaaagcctggcagagacacaacaaaaaaaagagaattttagaccaatatccctgatgaaaatcgatgcaaaaatcctcagtaaaatactggcaaaccgaatccagcagcacgtcaaaaagcttatccactgtgatcaagtgggcttcatccctgggatgccaggctggttcaacatatgcaaatcaataaacgtaatccagcatataaacagaaccaaagacaaacactacatgattatctcaataaatgcagaaaaggcctttgacaaaattcaacaacccttcatgctaaaaactctcaataaattaggtattgatgggacgtatcccaaaataataagagttatgtatgacaaacccacagccaatatcatactgaatgggcaaaaactggaagcattgcctttgaaaactggcacaagacagggatgccctctctcaccactcctattcaatatagtgttggaagttctggccagggcagtcaggcaagagaaagaaataaagggtattcaattaggaaaagaggaagtcaaattttccctgtttgcagatgacatgattgtatatttagaaaaccccatcatctcagcccaaaatcttcttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaagggatgtgaaggacctcttcaaagagaactacaaaccactgctcaatgaaataaaagaggacgcaaacaaatggaagaacattccatgctcatggataggaagaatcaatatcgtgaaaatggccatactgcccaaggtaatttatagatcaatgccatccccatcaagctaccaatgactttcttcacaaaattggaaaaaactactttaaagttcatatagaaccaaaaaagagcccacattgccaagacaatcctaagccaaaagaacaaagctggaggcatcacgttacctgacttcaaactatactacaaggctacagtaaccaaaacagcatgatactgggaccaaaacagagatatagaccaatggaacagaacagagccctcagaaataataccacacatctacaaccatctgatctttgacaaacctgacaaaaacaagaactggggaaaggattccctatttaataaatggtgctgggaaaactggctagccatatgtagaaagctgaaactggatcccttccttacaccttatacaaaaattaattcaagatgaattaaagacttaaatgttagacctaaaaccataaaaaccctagaagaaaacctaggcaataccattcaggacacagacatggacttcatgtctaaaacaccaaaaacaatggcaacaaaagccagaattgacaaatgggatctaattaaactaaacagcttctgcacagcaaaagaaactaccatcaaagtgagcaggcaacctacagaatgggagaaaatttttgcaatctactcatctgacaaagggctaatatccagaatctacaaagaactcaaacaaatttacaagaaaaaaaaacaaccccatcaacaagtgggcgaaagatatgaacagacacttctcaaaagaagacatttatgcagccaacaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacatttttacactgttggtaggactgtaacctagttcaaccattgtggaagacagtgtggtgattcctcagggatctagaactagaaataccatttgacccagccatcccattactgggtatatacccaaaggattataaatcatgctgctatagagacacatgcacacgtatgttcattgcagcactattcaaaatagcaaagacttggaaccaacccaaatgtccatgaatgatagattgaattaagaaaatgtggcacatatacaccatggaatactatgcagccataaaaaatgatgagttcctgtcctttgtagtgacatggatgaagctggaaaccatcattctcagcaaactgtcccaaggacaaaaaaccaaacaccgcatgttctcactcataggtgggaattgaacaatgagaacacttggacacaggaaggggaatatcacataccaaggcctgtcatggggtagggggagcaggctt

SEQ ID NO: 9270 - DNA, 4403 bp, Homo sapiens
aaaacaatctacgaagcaggcactataataagccccgttttacagaaggagaaaatgagacacaacataaataacttgcctagttatgggcaaataacttgcctagtttatgggcataaataacctgcctagttattgcctagtacatgggcagaggggagttttggaccagacttgagagatcgtgctcttacccactgctgctctgaacacataataaataaagtataactcactgttattaaagcacagggtgtgagggggaggactgaggagtgccgctgttgagagggcagaagtcagacagagcctgaggtcagtttgggatggtgttgaaaggaccctgtggacatccagactcctgaggcaattcgaccacacacctggcgttaaggacacgatctgagctggagaattgaagttactgttaggaacgtagttgaaatcactgatgagtgtggctttatgacaaggagtaaaggagcagataccattaatatgctgtggaaaatagggaggatgagaatgataataaaaacagctgcagcttattgaatccagagctcattctaagcactttatacgtaatgaataagtaaccagaagctttgtcacttatgtgtataaaatcctttatagtacaacctatggctaatattgatgccataaatttgttgtcctagcaatatagggcatctaacttctatttagaaaagatgatttatttatttttttatttctaaatcatgtgatgattagagcattttcagggagaaaggtgtttaatcagtatttttttttatttcttttccattcaagtgtttcattaacatcttcaacactcattatcttttccacaaattttttattatgctgtactttgaaataatgaaataagtatacctacgctttaaaatgaggatgcatttagtatcaaaaatatagtcttatactggagaatgtttcccagtaggaaaagcacatggcttgggctttttatgaaaaccacatttgtggtgctcacttcggcagcacatatactaacattggaacgacacagagaagattagcatggcccctgtgcaaggatgacacgcaaattcatgaagcgttccatatttttaattgaccacatagttgaaagtaaagcactcatcagcaaatgtaacagaaaagaaattataacaaactgtctctcagaccacagttcaatcaaacaagaactcaggattaagaaactcactcaaaaccactcaactacatggaaactgaacaacctgctcctgaatgactactgggtacataatgaaatgaaggcagaaataaagattttctttgaaaccaatgagagcaaagacacaacataccagaatctctgggacacattcaaagcagtgtgtagagggaaatttatagcactaaatgcccacaagagaaagcaggaaagttctaaaattgacaccctaacatcacaattaaaagaactagagaagcaagagcaaacacattgaaaagctgcagaagtcaagaaataactaagatcagagcagaactgaaggagatagagacaaaaaacccttcaaaaaatcagtgaatccaggagctggttttttgaaaagatcaacaaaattgatagactgctagcaagactaataaagaagaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctggacacatacaccctcccaagactaaaccaggaagaagttgaatccctgaatagaccaataacaggctctgaaattgaggcaataattaatagcctaccaaccaaaaaaagtccaggaccagacggattcatagccgaattctaccagaggtacaaggaggagctggtaccattctttctgaaagtattccaatcaatagaaaaagagggaatcctccctaactcattttatgaggccagcatcatcctgataccaaagcctggcagagacacaacaaaaaaaagagaattttagaccaatatccctgatgaaaatcgatgcaaaaatcctcagtaaaatactggcaaaccgaatccagcagcacgtcaaaaagcttatccactgtgatcaagtgggcttcatccctgggatgccaggctggttcaacatatgcaaatcaataaacgtaatccagcatataaacagaaccaaagacaaacactacatgattatctcaataaatgcagaaaaggcctttgacaaaattcaacaacccttcatgctaaaaactctcaataaattaggtattgatgggacgtatcccaaaataataagagctatgtatgacaaacccacagccaatatcatactgaatgggcaaaaactggaagcattgcctttgaaaactggcacaagacagggatgccctctctcaccactcctattcaatatagtgttggaagttctggccagggcagtcaggcaagagaaagaaataaagggtattcaattaggaaaagaggaagtcaaattttccctgtttgcagatgacatgattgtatatttagaaaaccccatcatctcagcccaaaatcttcttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaagggatgtgaaggacctcttcaaagagaactacaaaccactgctcaatgaaataaaagaggacgcaaacaaatggaagaacattccatgctcatggataggaagaatcaatatcgtgaaaatggccatactgcccaaggtaatttatagatcaatgccatccccatcaagctaccaatgactttcttcacaaaattggaaaaaactactttaaagttcatatagaaccaaaaaagagcccacattgccaagacaatcctaagccaaaagaacaaagctggaggcatcacgttacctgacttcaaactatactacaaggctacagtaaccaaaacagcatgatactgggaccaaaacagagatatagaccaatggaacagaacagagccctcagaaataataccacacatctacaaccatctgatctttgacaaacctgacaaaaacaagaactggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacacagacatggacttcatgtctaaaacaccaaaaacaatggcaacaaaagccagaattgacaaatgggatctaattaaactaaacagcttctgcacagcaaaagaaactaccatcaaagtgagcaggcaacctacagaatgggagaaaatttttgcaatctactcatctgacaaagggctaatatccagaatctacaaagaactcaaacaaatttacaagaaaaaaaaacaaccccatcaacaagtgggcgaaagatatgaacagacacttctcaaaagaagacatttatgcagccaacaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacatttttacactgttggtaggactgtaacctagttcaaccattgtggaagacagtgtggtgattcctcagggatctagaactagaaataccatttgacccagccatcccattactgggtatatacccaaaggattataaatcatgctgctatagagacacatgcacacgtatgttcattgcagcactattcaaaatagcaaagacttggaaccaacccaaatgtccatgaatgatagattgaattaagaaaatgtggcacatatacaccatggaatactatgcagccataaaaaatgatgagttcctgtcctttgtagtgacatggatgaagctggaaaccatcattctcagcaaactgtcccaaggacaaaaaaccaaacaccgcatgttctcactcataggtgggaattgaacaatgagaacacttggacacaggaaggggaatatcacataccaaggcctgtcatggggtagggggagcaggctt

SEQ ID NO: 9271 - DNA, 360 bp, Homo sapiens; identical to SEQ ID NO: 9268

SEQ ID NO: 9272 - DNA, 2239 bp, Homo sapiens
agtgagactctgtctcaaaaaacaaacaaacaaacaaaaaattaccaatcttcaactattatcaagtcatgattatgaacattaatccttagtttgtgcttttttagaagtagtaaatataggagtttgggttggcatgcactaatccaagcatttaagtggagatttggaatgtgatgggcagttctacaggaagagaaagagagagggagggaaagcgagagatagagggggagagagaggacaacatgtttcactttgttagttgtttggatttcaggtttttgggagtagaatgtacaaccccaacagatgcaatgcggttagtttatggagtctatgcatgttttatcctggattttcagtgttatcgagggatataagtagaattattattgatttctttatgtatgaatggtaggtgagaaatacttccttgaaaggcaggcacaaaagagagtattactactctgcctgctcattcattcattttagctactcatggtgtgccaggtactttgctagtactttgtaaaacaatcttttaatccttcattttgtgattgaagaaactgaggctcagtgagattaagacaatttcccaaggtcacagagcaactggagctggttcatttccaaacctcttgtacaatttcctctgtgccatgtaacctttcctttattcatttgttctatgtgtgtatatctgtaaatcatttgtatttctttttatttaagtttgggaacacatgatatttcgttttgtcgtatataccagtaagcaaaacaaagttccaaatagatgtgctgaaactgacaaatcataaagaaaaccctaagtgtttaaatcatgaatagtcagtcccacaggaggaaggctctaggaaggaacttgtacaatgtgcctcctcctggctgctgcttcctgacgcagctggtcaaatgtaatttcagaagttttgctaaaaccttctctgaaggtgtttttagctacaggtgaaaggatgaaacatcaggaactttggcagggttgtgcagagacaaaggaagggaaggattggccctagtgtgtgagctgtgagctgctattagcccagagttttgtttagtggatacttaacctgtgtgaggataaataatacacagtttgacaggataaactgaagtcaacatggtagcttcttcttttagggttctccctttaaaaattttcttctattccccattttctttaaccactctgcgttcattttcccgtttttccccatctccctctttttcctcctgttcctgtccttttgtgtttttggaccccaatccatgttgccctcttttttatttgttttatttcttctttctacatttattctctttttttcctttcttttatttagtcctttcctttctccctcccccacaacctccttatatttcttcttcatctactctcgcttgatattttctgcaaagcgctgcctgggccccttgacctcacaagaagctctctgacgaaacgcttaagaaaaacaaggtattatgcattatcctacacattctgcaatcgccctagcaatttagtaactacagtccaatttaaaccaggcctcaaggcaacaaaaattgcaccaaatgccaactaatttaccaaacttatagaaggaatatttgggagtctattcccttcaacccatctgattcatattattgactcatttagaaaacagaaagtgaacagagacaagtttttaaggagtttggtttcatgcaaatgacttgcaattgcagcccattatttttataccacgacttcattagtcatatccctgtcagacctgtgaccagtgtcaaatgttttcaaaaagcacaccaggacaggcatggaactcatcagcctgtgtcaaaggtcgctctcattaaggagtcaaaatgaaaactttcagtgtctctaacacatcgcatagctctccctggtactcccacccccagtcctgaaatccagggccagctaagcacctccagctccccagacattcaaataagatcaagatgacagggcaagaaaatgaatagagttcttacccggctggacctcataatctggtactgattgaaacaaccagaaagctgtttgccaggtcttatagcaccatttcctgaggttaaacataacatctcaaaatgaagcaattaggggtttctccaaaacaagagtcttcagtaattaaaaaagaaaaaaaaa

SEQ ID NO: 9273 - DNA, 291 bp, Homo sapiens
tttttttttttttttttttgaggtggagtttcgctctttcgcccaggctggagtgcagcggcgccatctctgctcactgcaagctccacctcttgggttcacgccattctcctgcctcagcctcctgagtagctgggactacaggcgctcgccaccacgcccggctaattttttgtatttttagtagagacggggtttcaccgtgttagccaagatggtctctatctccagacctcgtgatccgcccgccccggcctcccaaagtgctgggattacaggagtgagcccccg

SEQ ID NO: 9274 - DNA, 558 bp, Homo sapiens
agaaagaagaaaataaagactatcatggtaggagctgattaggcccattaggtagggtttgatggtggaggaactgcttttttttgccacctgggaggtcaacttttgattatggaagcagtaggtaaagaagaacttatcgataatagtgctataaagatggacattaaggaatctgaagatcagagataagaagaaaaccatctttcccaggactcatttggacaatatggaatatcagagattcggtgctccttttcttgtttcattttgttttgaatcattactgcttttctgaagacctgttcactatgtgagcatagcctctgtgttatgatgctataagggatttccaaagaggtctgagtgatggtttcttattttccttcagaatcttcttcaagccacattctggtgttggtgttggtgttggatttgggttcctaggagacttgaaacatggattacatcctgtcaccacaatatttggctggttacagtggctttaagattgatgaacagatatttccagtatcacgtggggtaaatgtcaaggaa

SEQ ID NO: 9275 - DNA, 7231 bp, Homo sapiens
tgtactttactgctcttatactatctctgagtcagcaaatgacaagtgacagaatccacctttacacaccttcttctgttaatggtagcctctggtaagaattcacaatgacattagcaattgttaatggcaataacagcaacttttcttatccttccattctttttcaactgcaaataatgaaggctctgtttttgtttccaaatatatggcaagaaaatacttattcctttggttaatgggtaactattgttatgtccacctgcatttttaatgaaatatcttccttttaaaaatctgttttagatcttcaagttatagtttttttttttttcgagatagagtctcgctgtgtcacccatgctggagtgcaatggcactatctcggctcactgcagccaccgcctcctgggttcaagcgattctgcagtcttagcctcctgagtagctgggattacaggcacccgccatcatgcctggctaatttttgtatttttgtagaaatgggcttcaccatgttggccaggctggtcttgaacttctgacctcaggtgatccacccgccttggcctcccatattgttgggattataggcatgagccactgcgcccagccaagttatagttctaaaataagtcatcatatgatggacggaaggagccctgcattcttaccccctgtcagggagtttcatatcccagaacagtgatgggagtgagtagctgggatagattcagaaaaccaagcaatgctagaaagagcggaacagggagagccaacatctgcagatcagcggccagccatgaagctgacaggatggctgagattatagttcataaaacttagagaagcagtcttttttttttttttttttttttttccccaaatgctgcacgtagcatccaaaagtagtcttttttgagagagtggctagggacattaggtaaagagaaagcaaagatactttattgaggattaatgtcatggtagttggaaggaaaacttttagagaattttcttgggaatactaactttgcatttatatgaatgtatacagcagatctgttcagagtttaaataacctttgaacccttgttctcattatatatgtggtatattttacagggaaattatattttctttcacactttacttgttatttctctaggagaggactgctgttttttcttaaagttcataaaatagatatatttgtgtatatgaaccaaactgaaggcacttctaatgagtgtttctacatttttagggaagcaggaattgaggaacagattctccagccatggattgtggtgaatctcgtggtggctcttctggttggattatcttggctatttttgtcttataggccaggcatggatcttagtgaaggtattaaagaaaaaaaatagcataagaatatcctgaaatcttctataatggttttataaacctccttttaataggtatagcttataatattccaataacaaagacacatttaaattaaaatgatacaagaagagagaaaataaagtggtgtaacagaatgccaagagaagcagggaggagtgtctaggagggcttgagtctggaactacttaatgaggggcttctgtggcccttgtgcattttcaggaggtatttcttctcttggaacccttcaagtaatgtagaaaaagtctttgctcttcacttctcttagtctcctgctgatgaattttgaaataaatcatgctttgtctacatagcctctctgtcggacacatactcaagtcaattattcttccttctctatttggtacaaattcttaaccgttcattggctaacagtgtttagtactcttttaacatgctcagtgtgcagtgattcactcatctctagtccccagaccccttttggaacacctgaagaagaatcatcatattagcaaactgctaaccttttatgctgcttgaggaactgtttagtatttgtattgtaaattgtgtttccttggccaatgttcaacagttttacccttgaatatctttttttttttattttttatttttggagatggagtctcgctgtgtcgcccaggtcagagtacagtggctcgatctgggctcactgcaagctccgcctcccgggttcatgtcattctcctgcctcagcctcccgagtagctggaactacaggcgcccgccaccacgcccggctaattttttgtatttttaatagagacagggtttcaccatgttagccaggacagtctcaatctcctgacctcgtgatccgcccgcctcggcctcccaaagtgctgggattaaggcgtgagccaccgcgcctggccaaacatcttttatggatattttctgggtcttggttattattttattttttatttgaccaactatttacaacctatctgcctcagaagccttagcatgcagaatttcgccaacatctatgctaagtaatagtttaaatgtagaaaatgtcagctaataacattctacattgtggctgggatcaaaactgcatctggattgtgcagtattcagtctaaatatttccagaatcctgttcttttaaggccatgttagtcatacaacatgtggatttaaaaagtaagtataaaatgagatgataatacctggcttcttgcgttgttttgatgattaaatgggatgacccatttaaaatatcctggcacacatctcttgttagttccaagtccttcctctgtatctgtcccctatgtttcagatgatctgatcactgtagaattagacattttagctgtttaatgatctttgattctctaagtgacttaaatttccaggtaggattgtgtatattgtctctattacattttacttttaaggggtctataatttaaaatttaaatattttaaaatgtaaaacttgtacatttgttatcagcttaccttttaaatcatatttcactgtcaagaaatcttacttgagggctttctattagtatatattatgtcaattttttaaaggactatttataaataagctatacaactctgttggaggtactgggaaacaattttaagtatgatctgttcattttcttctccagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 9276 - DNA, 5027 bp, Homo sapiens
tatttttattttttattttttattatactttaagttctagggtacatgtgcacaacgtgcaggtttgttacataggtatacatgtgccatgttggtgtgctgcacccattaactcgtcatttacattaggtatatctcctaatgctatccctcctccctccccccaacccacgacaggccgtggtgtgtgatgttccccccccgtgtccaagtattctcattgttcaattcccacctatgagtgagaacatgcagtgtttggttttctgtccttgcgatagtttgctgagaatgatggtttccagcttcatccatgaccccacaaaggacatgaactcatcctttttatatggctgcatagtattccatggtgtatatgtgccacattttcttaatccagtctgtcattgatggacatttgggttggttcctagtctttgccattgtgaatagtgccataataaacatatgtgtgcacgtgactttatagcagcatgatttataatcctttgggtatatgcccagtaatgggatggctgggtcaaatggtatttctagttctagacccttgaggaatcgccacactgtcttccacaatggttgaactagtttacactcccaccaacagtgtaaaagcgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatactttgcccactttttgatggggttgtttgtttttttcttgtaaatttgtttcagttctttgtagattctggatattagccctttgtcagatggatagattgcaaaaattttctcccattctgtaggctgcctgttcactctgatgctagtttcttttgctgtgcagaagctctttagtttaactagatcccatttgtcgattttggctttggttgccattgcttttggtgttttagtcatgaagtccttggccatgcctatatcctgaatggtattggctaggttttcttctagggtttttatggttttaggtctaacatttaagtctttaatccatcttgaattaatttttgtataaggcgtaaggaagggatccagtttcagctttctacgtatggcgagccagttttcccaacaccatttattaaatagagaatcctttccccatttcttgtttatgtcaggtttgtcaaagatcggatggttgtagatgtgtggtattatttccgggggctctattctgttccattggtctatatctctgttttggtaccagtaccatgatgttttggttactgtagccttgtagtatagttcgaagtcagaaagcatgatgcctccagctttgttcttttggcttaggattgtcttggcaatgtgggctcttttttggttccatatgaactttaaagtattttttccaattctgtgaagaaagtcattggtagcttgatggggatggcattgaatctataaattaccttgggcagtatggtcattttcacaatattgagtcttcctatccatgagcatgtaatgtttttccatttgtttgtgtcctcttttatttcattgagcagtggtttgtagttctccttgaagagaaccttcacatcccttgtaagttggattcctaggtattttattctctttgaagcaattgtgaatgggagttccctcatgatttggctctctgtttgtctgttattggtgtataggaatgcttgtgatttttgcacattgattttgtatcctaagactttgctgaagttgcttatcagcttaaggagattttgggctgaggcgatggagttttctgaatatacaaacatgtcatctgcaaacagggacaatttgacttcctcttttcctaattgaataccctttatttctttcccttgcctgactgccctggccagaaattccaacaccatgttgaataggagtggtgagagagggcatccctgtcttgtgccagttttcaaagggaatgcttccagtttttgcccattcagtatgatattggctatgggtttgtcataaatagctcttattattttgagatacgtcccatcaatacgtagtttattgagagtttttagcatgaagggctgttgaattttgtcaaaggccttttctgcatctattgagataatcatgtggtttttgtctttggttctgtttatatgctggattatgtttattgatttgcatatgttggaccagccttgcatcccagggatgaagcccacttgatcatggtggataagctttttgatgtgctgctggattcggtttgccagtgtttcattgaggatttttgcatcgatgttcatcagggatattggtctaaaattctctgtttttgttgtgtctctgccaggctttggtatcagaatgatgttggcctcataaaataaatttgggatgattccctgtttttctattgattggaatagtttcagaaggaatggtaccacctcctctttgtacctctggtagaatttggctgtgaatccgtctggtcctggagtttttttggttggtaggctagtaattattgtctcaatttcagaacctgttattggtctattcagggattcaacttcttcctggtttagtcttgggagggtgtatgtgtccaggaatttatccatttcttctagattttctactttatttgcatagaggtgtttatagtattctctgatggtagtttgtatttctgtgggatcggtggtgatatcccctttatcattttttactgtgtctatttgattcttctctcttttcttctttcttagtcttgctagtgatctatcaattttgttgatcttttcagaaaaccagctcctggattcattgattttttgaaggtttttttgtgtctctatctccttccgttctgctctgatcttagttatttcttgccttctgctagcttttgaaagcatttgctcttgcttctctagttcttttaattatgatgttagggtgtcaattttagttctttcctgctttctcttgtgggcatttagtgctataaatttccttctacacgctgctttaaatgtgtcccagagattctggtatgttgtgtctttgctctcattggtttcaaagaacatctttatttctgccttcatttcgttatgtacccagtagtcattcaggaagaggttgttcagtttccatgtagttgagcagttttgagagagtttcttaatcctgagttgtagtttgattatgctgtggtctgagagacagtctgttataatttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaactttctgtctcattgatctgtctaatgttgacagtggtgtgttaaaggctcccattattattgtgtgggagtctaagtctctttgtaggtctctaaggacttgctttatgaatctgggtgctcctatattgggtgcatacatatttaggatagctcttcttgttgaattgatccctttaccattatgtaatgtccttctttgtctcttttgatctttgttggtttgaagtctgttttatcagagactagcattgcaacccctgctttttcttgttttccattggcttggtagatcctcctctatccctttattttgagcctgtgtgtatctctgtacgtgagataggtctcctaaatacagcacactgatgggtcttgactctttatccaatttgccagtctgtgtcttttaattggaccatttagcccatttacatttaaggttaatattgttatgtgtgaatttgatcctgtcattatgatgttagctggttattttgctggttagttgatgtagtttcttcctagcatcaatggtctttacaatttggcatgtttttgcagtggctggtaccgattgttcctttccacgtttagtgcttcattcaggagctcttctaatgcaggcctggtggtgacaaaatctctcagcatttgtttgtctgtaaaggattttatttctccttcacttatgaagtttagtttggctggatatgaaattctgggttgaaaattcttttctttaaaaatgttgaatattggcccccactctcttctggcttgtagagtttctgccaagagatctgctgttagtctgatgggcttccctttgtgggtaacccgacctttctctctggctgtccttaacattttttcctacttttcaactttggtgaatctgacaattatgtatcttggagttcctcttctcgaggagtatctttgtggcattctctgtatttcctgaatttgaatgttggcctgcctcgctaggttggggaagttctcctggataatatcctgaagagtgttttccaacttgattccattctctctgtcactttcaggtacaccaatcagagatagatttggtcttttcacgtagtcccatatttcttggaggctttgttcatttctttttattcttttttctatcaacttctcttctcacttcatttcattcatttgatcttcaatcactgataccctttcttccacttgatcaaatcggctactgaagcttgtgcatgcgtcacatagttctcgtgccatggttttcagctccatcaggtcatttaaggacttctctacagtgtttattctaattagccattcatctgatcttttttcaaggtttttagcttctttacaatgggttcgaacatcctcctttagctcggagaagtttgttattactgataatctgaagccttcttctctcaactcgtcaaattca

SEQ ID NO: 9277 - DNA, 9456 bp, Homo sapiens
ggcgcacgccagtaatcttagctacttgggaggctgaggcaggagaatctcttgaacttgggaggcggacattgccgtgagctgagatagtgccactgcgctctagcctgggccaaagagtaaagatctgtctcaaaataaataaataaataaaaaataaaaacaacaataaatgactgtgtgtccttaggcaaggcacttagcaactcttgagcttgttccatctgtaaacccaggacgttagtgattctccctctagtggatgaaatgaagcaatgcagatagagccctaatgcagggtacctgcgagtcgctgcagcagctgtggcaattgtcaccttcatccaggcccatcccgctttgagggcctagagagagtgggccagaggttaacccccgattcatctgcctccccacgctgggcatctgggtgtgccagggcattcccccgctggtcagacaggtttttgggccagggcggggctgaccagggttaattagagggaactggctaggaggagctggggagggggctgggcagagtccaggcctccagagcccctgggacacagcaggtgtgtgctgccatgggccggggcttgaactctgccagactcaggcgccaaaaacggcgcttgcgacctcaggtccagaagccccggcagcagctggaggtgagtggtcatcagagatccccccaccccaacccttgccccgggcccacgcgtcctgtctgctcggaaccttccctctaaatctctgggtcttgctcacgcttcctccctcactctcccttgcttttgtgtctgtcttggacacaaggcccccttaggctttctccctaggtgtctgtccctccatcgccatctctctgtgcctgcccagtctcatcggtgcctctctgcctctgtccctctgccctggcccccacagcggctccagcaggagaaccatgagctccggcgaggcctggcagcccgaggagccgagtgggaggcccgggccgtggagctggagggggacgtggaggccctgcgggcccagcttggggagcagcgctcagagcagcaggacagtgggcgagaacgggcacgggccctcagcgagctcagcgagcagaacctccggctcagccagcagctggctcaggtgggatggccctgaccccagggccctggacaaggttggggaggatgcctgggtccccagcggggagtaggtgcattgggcttggtgctgaggctcctctgtccctctttccacctccccaggcctcccagactgagcaggaacttcagagggaactggacgcccttcggggacagtgccaggctcaggcactggctggagcagagctgaggacgcggctggagagtctgcagggggaagtgagtgtcagctggggctgggggattatctgagccaaaaaagccgggctgagggctgggaggggctgcccctgtccccagctctcaggcctttccccagaaccagatgctgcagagccgccggcaggacctggaggcccagatccgaggcctgcgtgaggaggtggagaagggtgagggcagactgcagaccacccacgaggagttgctgctgctgaggcgggagcggcgggagcacagcctggaggtgacctgcagggctgggggactacaactgcctggacccttagcaatggcttcagggctttctgggagatgaggccggagctggatcactgggaggcccagaggctggcccacaagagcatgggcattagcccatgggcaaatgggagccacggaaggctgttgagcaggtgaggcatgctcttagagtgcatcagagcctggcagctggaagagcagggagggggctggtgccagagctcaggccaggaatgacagcccctagaccacggctgcgcaatggagacggagaaaaagaaatgaaaagaggatgcggtgtctgatgttagagatcaaaggagtctgcactttggggtcagcttgccttccttcgcatcccggtgccccttcttacttactactgtgggacaagcagcctcagtagcaccaataaatgctgcatgaaacaattactgaatgaggaggtagactgggcaggggaggagatggggctcttcgaggtgcggccctgctctataggcgaggaaactgtatatatccgctgagggaggtgcacggcccaaggcgcccagcgatccaggaacgggaacagcctgggccgctggggtgcggggctctccgcggcacccccgtgtggacctgccgcgggatgtcggcgttgcgtgcgtcccgctgaccgcccgcgcttccgtctgcgggaccgtccacagctggaacgcgcacggtcagaggctggggaggcgctgagtgcgctgcggaggctgcggcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccggtgagctcgtggggccccagcccccttacctgtgccatcgagagggttgcaggctccgcctttcctcctttccccaataaactccacaccactaacccatttctttggcccacagaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgaggtggggcagagggcacggtgctggatgcacggcccctccagctgtcagtttctgtctcccatgtccacctcccagcctttgcccactaagctccctatacctggatcggctttcatctcaacaaacttacttcaagagccagcctgtatgccacctcctccaggaagacttcctggacagcacctctgcccttagttccactcccaatgcttctccctgcatccctcctgcagggttataccactccaactaaccctgctccaccccaccccgcaccagcctgaggggctcagagggctcatatcggagtctccagcacagggccacggctgcctggggtgtctgtcgcaggcagaggaggggtggggagagccagagtcggggctgctgggagaagcagggaggcccattggcccatctgccgcacggcccccctcctctgctcacagatctcgctgcagcaggcagagctgcagtccctgcgggaagagctgcagaggcagaaggagctgcgggcgcaggaagaccctggggaggccctgcacagtgccctctcagaccgggacgaggccgtgaacaagtaagcctcaagccattgaccaccgccccagcgccctctgggccctcctgggctcctgattcctcttctgatacgggttatgatccccactcccacccaggggccccctgacctccttgatctaggtgtttgcagccctcctcccgcccgggtccagaagtcccccgccaccccggctccctgaggccctagcgccctcaaacgcgtcttctgctcctgcccgcctagggccctggagctgtccctgcagctcaaccgcgtctcgctggagcgagactccctgtctcgggagctgctgcgcgccatccgccagaaggtggcgctcacgcaggagctggaggcctggcaggtgaggggcggggcccgtgtgcggggcggggcaaggggcgggaccggcgctgagccgaccacggcctcccgcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatataggtctatcttttctagggcagggatggggctgggtatttatgtatcaagatcggacagagtaatatataaatcactccaccgatttggcccccattcatagaaagaaagagcatggtaaaaaagcctgaaactttattgtaaaaaaaaaaaaaaaagaaaatgaaaaacactctaaaaccctgagctggctgggggtgtcgtcagagatcagaaggacagggagaaggctcggtaacccaggttggtgaagacatccacccggcagctgttgcctgcagctgtcaggacctggaggaaagaggggcatgactggcctgcccacacccctgcctcccagccgctccgcggcccctgccggacccaccttgcactcaggcgcggcaggctgctggttgaggctgaggctgagcagccctggggaggagccaggcacctgggccttcagctccccgctcagctgccactggttgacgcagcggccctggccagctgacagaatctgcagaggacagggaaggtgctcaggggtcaggactgaagggaagagtcagtgggggtggcagaagtgagacacagggcctcaccaggtcctggtagaaggtgacgtgcttctgtggcgcccggatggggaagatggtggtgggtgtggaggatcggaggtgccagagggtgagggctgggccccctccacagacctggacagaaaggtgggagtccccagctgtgaaccacaggcccacagctgacagggcccggagctgccatcccatcccacagtctgcccagctcaccatccagtcggaatcagttgccaaacatccaatccagcgcccattgtggggcctcgagcactcctgggatggggaggggaggagggaaagaggtgaagacctggagaattcaaggagttgggggagaagaggacaatggccacggtcacaccctcacctcgtgcttatagacctcgatcgtctggacctccttggctgtgcgcaggtctgcggggaaagaactgtgagtggtgccccacttgcctcagcctccttcactgccatcttgccctccaaccagccacctgcttaccccaaagtcgaacagctccatcctcgccacctgacagcacctctgggctcctttcccgcagtgccaggcagtggatgtagtctgtgtggccccggaggaccctctgcatgtagaggggcgatgtcaggaggagacctaggaagagtgcctctccctgacctagacctgctctagggctccaggaccctgctcaccgtgaaagtcccagtttcaaggtccatagtgtgcaactgacagtctcccccagccaggatgagggaattctcctgtggaggagcaggatgaggcagaaagtcaatgtcaaatcaggataggcagagggtgaaggatcaaagtttggaccaagaacagtcacatggggctcagaccttggggaccagcagcaaagcgttgatctcaggcacttccaggctggtcctggggaaggaaaggcaaggtcagtgaggaagtggcttcaccctgatgcaccctctatccacgtggccctgctcacctgtatggaggctgacgacgccacagctccttacagcccttcaaaagagaaaataccaggtgacctcaaaggctctctctgggtccaggcaccccagccctttcccaagctcgactccttaccttcttgagcatctccgcccaaagccaggccttcacctccccatccccagcactaagcagatgtcgatcggtggaaaccatgctatagacgggcccatcatgggctaaagagaaatgcagaactgagtgagccaatcccacccaaagtcctgaagccagactccacagctatacccaccttggaaagtcaccaccggcttcttactttcctctttggcttctgagctcaaagcagaggacaagctgcagggacagcggaggggacccaggagtcagaaacgggggcatccgtcccatgagggccaagtgccagggctaatgggtggacagcggcagagggtacctgaagatggcaatctgcccgtaattgttgccagccgccagaaacttcccacatggtgagacgctctgggagaagatggtcatatggagccgctgcaaggcctggaacacctctgtctgcaggaaaagactggatgaggcctgcctgggacgtatgaaacctcccatccacagattcctccctgcttccccgaaaacctgccaggcctcccactgtcctgacttctcagccttcttttgaggcggccccgccccaagccagcacctgcccatgcagtcccatgggtggctccaagaagacactgaagaaggggagagttgaggtgatgcctcagggacctctgagcaagcacccaggcctctcctgccagcttcctcaactgacaaatggagctcacagaagattccatcacaattagatgagctagtgtatagacaagagctttacatggggctgtcactcagtgcttaagccgggtgtggtggttcatgcctgtaatccagcgctctgggaggccaggagtttgagagcagcctgggcaacatagtgagactctgtctcaaaaaaaatttaaaaatgtggggccgggcgcagtggctcacgcctgtaatcccagcactttggcaggccaaggcaggtggaccacctgaggtcaggagttcaagaccagcctgaccaacatggagaaaccctgtctctgctaaaaatgcaaaattagctgggagtggtggcgcatgcctgtaatctcagctactcaggaggctgaggcaggagaattgcttgaatctgggaggcggaggttgcggtgaacccagatggagccactgcactccagcttgggcaacaagagtgaaattccatctcaaaaaaaaaaaaaaaaaaaaatttggccgggcgtggtggctcacacctgtaatcctagcactttgagaagccaaggcaggcagattacctgaggtcaggagttcgagaccagcctggtcaacatggtgaaaccctgtctctactaaaaacacgaaaattagctgggcatggtggcacacgcctatagtcccagctacttggagggctgaggcaggagaatcgcttgaacctgggaggcggaggttgcagtgagctgagatcgcgccactgcactctagcctaggtgacagagtgagactctgtctcaaaaaaaaaaaaaaaagtgctttgcaagaactagaaaattaaaaaaaaaaaaaaagtacctctactaccccaacatagaaaaacgtactgatttataattcctactctctgacttgcgttaagcccctgaagcacttctgggttactatcccgcccccctggtcagagtctgagtcccacaaatagcccaggcaaaacagggctcagggcacgattccctgcccgccccgtcccagccatgcgtgaactacaaaccccagaaggcaacgcgcaccacgtccgtctcacctgacccagaggcaccgcgagcggcacagctcgctccatctccagaactacaagtcccagagtgctccgcgcgcgacgcaacctcacgaggccttacgtgcctagagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccaggtgcgtgtaggggaccagggtgggcctgaccaagggccgcaggagctttggctgggtgctcaggactggtctgcaggatgaatacggggtggggcgaatcggcggggcttaggcgtgagctgagatgggactggggctgcggctgagggtcgagacttccgaggtaccctgctggatggtccaggagagcggggaccggcaccagctgagacaggaatgggcttggggctcctggctgatgctgcaggcttaggcgggcagatccttgggaaggggccaagagggtggggtgcaccaggctctctttttttcccagctcccctctccgaggagctgtgcccatgagcaccaagcggcgcctggaggaggagcagtgagtttgggggcagggagggactcccaacaagatctctgtcacctctggtccccaacaggctgcctcctgtgtcagtatcccagcctgcctctctgccatctctccccagggagcctctgcgcaagcagtttctgtctgaggagaacatggccacccacttctctcaactcagcctgcacaatgaccacccctactgcagcccccccatgaccttctccccagccctgcccccactcaggtaggttcctccactggccaggccttctgcagaatcacaggcggtcctcacagctgacctcaggccctgcctcatcgtgccatttttagctctagctgacctctgggttgtttcccatcttggctctttggaaagtgctgggaacccaggagcccctggggacctggacctggtgggaggtgctcagctaggccagcctcagctccatgccctgacagtcatttcctcttctaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaag

SEQ ID NO: 9278 - DNA, 246 bp, Homo sapiens
gtccatgccctctggactctaagctgcttgaagcagtgaacttggtggtctcacgtgccgctgacagcagaccccagaacaagtggagctcaggaaatgtgggaggattgatagcagtgtgggtggatagacttagagatattgtgtccaggccacaaggcatcagcagagccgagcatcagccaggacaatctgaccctgaacctgacaacttaatcctgaagctgtgttgcctctgcagtattc

SEQ ID NO: 9279 - DNA, 2038 bp, Homo sapiens
tttaaagttaaagattcttttattaataaattctccctcccctccaaactctccccaaaataaatatctcctccccgctttggggagttgggggggtctgtatcttagggccagccctcctagtgggccagccccctagtgttaaaaataggtccctaaccccccagggtgacccccgtggtggaatttcaggacatctgagtgagtggggcctagtgtcaagtctgccccccaagtcagcctggcccccagggcctctaggaaggagggcacccccctcccctgtgcaaatgctgcagttccttagtcagtgtcagctgttttgtgtgagccagcgtgaggctccctttctgttctggagccagaggcagggcaaccagacaccttggaaggttcccctgaaccctgggcccaggcctcagaggtgattcaccgccccccaccccccttgtggttggaggagcttggctcccgccgcgtctgggaggcagagactggctctagaatggatgaatgaatgatgagtgggcgagccccggctggcagggggcacattgtcactggatcagcgccacagctgggcagccctctccgccggtctcctctatgggggctgcaagataagaggtggggtcgtcagcagcagagaaaaggtcgagtgctgacagggctgggcaggccagggcacacttactggtgaacttctctctcctgcggcatcgtctccagaccaaaaagccagaaagcagccccagcacgaaggtcaggctcagagcgcccccaaggatgggccaaagcagccggaagggggcaggaggtgctgcagcgcctgggggcgggactcggagtcagacctcgcccctctccaggccagccccgccccctaagactgagccttctgccttctcccaaacgtggcctcctccctgaccggagccccctcccagctcccacctcctcccgattgatttcccagatgcaaagctctcggccccgctctgcgcaccagccaccctccctcccagtctggggtccgctggccactggccctgccccccactcacagcccaggcagaagtcgctgtgcggtcgcgccctgcaagacgcgcagtccatgcacttgtccaggtccgcgctccaggagctgccgcgggagcagggggcggtgcctggggagggggcctcgggtcagaggctgggggcgggactcggctattctggggtctgaggtcagggtcggccggctcgaataacgtgagtcaccggcgccctccccgcgcattcctcacaggtgaccgcacggcccgaccgggacacggcagctccgggagggagggcgtagcgcgggacgctgggggtggggggggtcaggtccccacaacccccctgccgccggcgggtgactcactcctgggcaccgggcccgaccccagtccctccccccgcatagctgggcactgaagtcaccggatggaagggggcaccccacatggtatagagggcacagaccctagtgcctctcgacggcctccccaactcgtcgatcactggggctagttagaccctgtacggaccaggctgggggcgtgccccttcctagactaaacatcccgccctcactcactttctctctccattcgaagtacttcggacttgtggaactgaagacccccccaaccccaattggacggtgggagaaactgaggcccggattgtgaatgaagcttggagagtgatggaacttcccacagccgggagcgagctgtttgaaggccacctgaccccagatccccacatccgcctgttcccccagttcggcgctgttctccagacacccagtccggctcccgagccccggcccggggttccccgaccccggagtcccgcgtacctggcgcttgctccccggccacggagcgcagcaacgccagccagagccccagcacgaggagccgcagcaaccggcgcagcgagccccgagccatagtgcacgtcctgcgcccgccgctgtctgcgcccgccgccggccggcagggac

SEQ ID NO: 9280 - DNA, 2692 bp, Homo sapiens
gttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagataccacttgttttttagggattagccactctactagatttaatccttctgaaatcttgtctgactatagtcttgtctgactatagtgttttaatgctggactgtttattgaaacagcaggaagtgattcctgatagcaaaagttccaaagcgtcagccatcgcagttcctgctattctggttggtagcatgtaatttgtaatgcattcagaatccagttcattattttactcccatttagcaacagattgagaaagcacgtaatagtaaagccagctccttctaactctgaggccagcctctgccaactgaaggattctccccacagtcagcttcttctatgaactctgaagttttggcttaagacaaccacattgatactaaacaaggggaaacttttcttagaacaaaactaaaactgtgaaacagattccacattatctgggcacaatgaatcagataaaatgaaatataaaattaaggcaaagtctgtaaatggattcatgtcttaacagataaactcaggaggaataatttttatgtgatgtggtttaattggaagtgtcagaatctgaggaaactatagtgaaggactttattattactgaaaatataacctgggattataactattgttttttgcagtattttgcataagatgcttccttctcattgtgctccgttaatgaattacgtaaacttctaataatcctgaatcttttattcatagcatatattccctggtagtatatgttctattataaaagcatctgtggtatctaagttccccttgctaggagtgagctctttaagagtgaggactgtgccctagtcatcttcatatccctgatacctatgtgtaatatgttttcaatgaaggatttttgtttgtgaactcagagctcaaagtgtaattccaaccacttctccctatcctttgctcctcttttaaatggggactaatgataccttccatacctgctttacaaggttgtgtgaggctcagcatcttagagctaatgaatgaatatgttttctaaactgttgtcttatctcttcccctaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatcca

SEQ ID NO: 9281 - DNA, 2694 bp, Homo sapiens
gttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttgtctgactatagtcttgtctgactatagtgttttaatgctggactgtttattgaaacagcaggaagtgattcctgatagcaaaagttccaaagcgtcagcccatcgcagttcctgctattctggttggtagcatgtaatttgtaatgcattcagaatccagttcattattttactcccatttagcaacagattgagaaagcacgtaatagtaaagccagctccttctaactctgaggccagcctctgccaactgaaggattctccccacagtcagcttcttctatgaactctgaagttttggcttaagacaaccacattgatactaaacaaggggaaacttttcttagaacaaaactaaaactgtgaaacagattccacattatctgggcacaatgaatcagataaaatgaaatataaaattaaggcaaagtctgtaaatggattcatgtcttaacagataaactcaggaggaataatttttatgtgatgtggtttaattggaagtgtcagaatctgaggaaactatagtgaaggactttattattactgaaaatataacctgggattataactattgttttttgcagtattttgcataagatgcttccttctcattgtgctccgttaatgaattacgtaaacttctaataatcctgaatctttttttgcatagcatatattccctgttagtatatgtcccattatatatccatctgtggtatctatgttccccttgctaggagtgagctctttaagagtgaggactgtgccctagtcatcttcatatccctgatacctatgtgtaatatgttttcaatgaaggatttttgtttgtgaactcagagctcaaagtgtaattccaaccacttctccctatcctttgctcctcttttaaatggggactaatgataccttccatacctgctttacaaggttgtgtgaggctcagcatcttagagctaatgaatgaatatgttttctaaactgttgtcttatctcttcccctaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatcca

SEQ ID NO: 9282 - DNA, 776 bp, Homo sapiens
agtgtgtccggaattggtgggtttttggtctcactgacttcaagaatgaagccgcggaccctcgcggtgagtgttacagctcttaaggtggcgtgtctggagtctgtcccttctgatgttcagatgtgttcggagtttcttccttctggtgggttcgtggtctcgctggctcaggagtgaagctgtagaccttcgcggtgagtgttaacagcttttaaggtagcgcgtctggagttgttcgtttctcccggtgggctcgtggtctcgctggcttcaggagtgaagctgcagaccttcccagtgagtgttacagctcataaaagcagcgtggacccaaagagtgagcagtagcaagatttattgcagagcaaaagaacaaagcttccaccttttggaaggggacccaagcaggttgccaatgctggctggggctgcctgcttttattctcttatctggccccaaccacatcctgctgattggtagagccgagtggcctgttttgtcagggcgctgattggtgcatttacaatccctgagctagatacaaaggttctccacgtacccatcagattagttagatacagagtttccacacacaggttctccaaggccccaccagaggagctagatacagagtgtccattggtgcattcacaaaccttgagctaaacacagggtgctgattggtgtgtttacaaaccttgagctagatacagagtgccgattggtgtatttacaatccctgagctagacataaaggttctccaaggcccca

SEQ ID NO: 9283 - DNA, 900 bp, Homo sapiens
agtgtgtccggaattggtgggtttttggtctcactgacttcaagaatgaagccgcggaccctcgcggtgagtgttacagctcttaaggtggcgtgtctggagtctgtcccttctgatgttcagatgtgttcggagtttcttccttctggtgggttcgtggtctcgctggctcaggagtgaagctgtagaccttcgcggtgagtgttaacagcttttaaggtagcgcgtctggagttgttcgtttctcccggtgggctcgtggtctcgctggcttcaggagtgaagctgcagaccttcccagtgagtgttacagctcataaaagcagcgtggacccaaagagtgagcagtagcaagatttattgcagagcaaaagaacaaagcttccaccttttggaaggggacccaagcaggttgccaatgctggctggggctgcctgcttttattctcttatctggccccaaccacatcctgctgattggtagagccgagtggcctgttttgtcagggcgctgattggtgcatttacaatccctgagctagatacaaaggttctccacgtacccatcagattagttagatacagagtttccacacacaggttctccaaggccccaccagaggagctagatacagagtgtccattggtgcattcacaaaccttgagctaaacacagggtgctgattggtgtgtttacaaaccttgagctagatacagagtgccgattggtgtatttacaatccctgagctagacataaaggttctccaaggccccaccagagcagctagatacagagtgtcgattggtgcattcacaaaccttgagctaaacacagggtgctgattggtgtatttacaatccctgagctagacataaagactctccacgtcctcaccgga

SEQ ID NO: 9284 - DNA, 4842 bp, Homo sapiens
agaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaaccagc

SEQ ID NO: 9285 - DNA, 100 bp, Homo sapiens
gagacagagtctcactctgtctcctaggctggagtgcagtggcgcgatctccgctcactgcaaactccgcctcccaggttcacgccattctcctgcctca

SEQ ID NO: 9286 - DNA, 1555 bp, Homo sapiens
ggagaggagacatttgtttcacagcaaacatatgaataccaaataatagtgaaacccaagaaggccagtggtttatagaaagttgtaggaagtgaatattgaaatctgtaaatatgtaaatatatttagataaacataagatgaacaacacgttttacatgtgtgtattagtagaacattttttgtgcctcatattgcatagatgggtcaatgaaaacagaaaaaaaagaaacataaagaaagtgagagagagggagaaggaaagggagagggagagggaatgggaatgggagtgggaggaagggagggagggagagagaaaaagagggaggaagaaagggaggaaaatagttaaacaagcaagatgaacagaaacaaatatctgctatactctgaatgtcaaaatggaaatagcctgtgtaaagttctgcaaaaccataaatgtaatagatttattttaacaaggtaccaaagtactgtatgtttaagaaatttatcatttttcaacttcctaatttatttctggatggtgacattttaatttaaataaacagcagctgacagtatgacactggagttgttaatccaactattcttgtgcctcatgtgggtgttaggaattaaacttactatttgctaagcagcttacctgacaagagtcagattttttccccctaaagaaaggactggcactgtagctgtatgctttattataaatgatcaatttgttaccctcctataaaacagtgggcatttctccgtagactactctcatgtatctggagaattagcattgtttccatctaccagaataagacacaccacaccacacacacacacacgcacacacacacacacgttaaagctaaaattctaataataaaactgattaacttttaaacatctagccatgttctcatcaaagcattcagctttagtagagatataggtttatttttataatattctaacattagcttaaatgtttcctaattttatcatgtggaattaccccctatcaatcacacgttttgagcatcttcatttgtgatcctttgagaagggagtgtgtatatgtttatatatacacatatcaatacatatcatttacctaaattggtagattgagttgtcagagagagtttgatcaaaatatggcaggttgtttcaaagatatggttgttgtgtggaccagatcattgctgagataatgtagccaaatcacagactggtaagctagactttttcaatcacatagagtctgtaaaatacttcagaatttaaataaaactccattgctcatgcaaaactcatcagataagttcaaggagtcaatgacattgatatttcaaaaactcaacattggcttcacttgcgttattgacaagcatgtttcttggatctctgggaatttgtaggtttgccctgtggattttgactgttttcaaagttctaatgatttctcagtcgttcttcttaacttcagaaaaaaaaatgcattgttttctcatctttcctatgcaaaaccaaaataaaaaattgattctttgtttta

SEQ ID NO: 9287 - DNA, 1244 bp, Homo sapiens
gggagagagaaaaagagggaggaagaaagggaggaaaatagttaaacaagcaagatgaacagaaacaaatatctgctatactctgaatgtcaaaatggaaatagcctgtgtaaagttctgcaaaaccataaatgtaataatttattttaacaaggtaccaaagtactgtatgtttaagaaatttatcatttttcaacttcctaatttatttctggatggtgacattttaatttaaataaacagcagctgacagtatgacactggagttgttaatccaactattcttgtgcctcatgtgggtgttaggaattaaacttactatttgctaagcagcttacctgacaagagtcagattttttccccctaaagaaaggactggcactgtagctgtatgctttattataaatgatcaatttgttaccctcctataaaacagtgggcatttctccgtagactactctcatgtatctggagaattagcattgtttccatctaccagaataagacacaccacaccacacacacacacacgcacacacacacacacgttaaagctaaaattctaataataaaactgattaacttttaaacatctagccatgttctcatcaaagcattcagctttagtagagatataggtttatttttataatattctaacattagcttaaatgtttcctaattttatcatgtggaattaccccctatcaatcacacgttttgagcatcttcatttgtgatcctttgagaagggagtgtgtatatgtttatatatacacatatcaatacatatcatttacctaaattggtagattgagttgtcagagagagtttgatcaaaatatggcaggttgtttcaaagatatggttgttgtgtggaccagatcattgctgagataatgtagccaaatcacagactggtaagctagactttttcaatcacatagagtctgtaaaatacttcagaatttaaataaaactccattgctcatgcaaaactcatcagataagttcaaggagtcaatgacattgatatttcaaaaactcaacattggcttcacttgcgttattgacaagcatgtttcttggatctctgggaatttgtaggtttgccctgtggattttgactgttttcaaagttctaatgatttctcagtcgttcttcttaacttcagaaaaaaaaatgcattgttttctcatctttcctatgcaaaaccaaaataaaaaattgattctttgtttta

SEQ ID NO: 9288 - DNA, 6010 bp, Homo sapiens
gatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaacggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaaggtgagttcaagaaagctacctgtggaaaatggaccaggttgggggggtgattgcaaagtctccccaaagcctggctcctcatgctcagtgccaggggcagaacactggggagccaggtatagagagccttcctgtcataactgccagtcctcttcctccaaggcctctgcatattctcatgttcccctcacccatcatgccagccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggagtccgtctcattctggctggtcgagtgaccagaggcctgtgtgaatgtgtgcacctgcttttcctgcctggaatgttttctggctcagctgcagcaacatctgtgagcccagtgtctgccctgtgtccctgggctcgctccaagtgcaggaacatacatgcagggcccaacatgatgatggtgtgaagggcaggaaacagtcctctgaaggagtggggaggtgggcagtctgcccccgccaggtaccatcgcctcctgccagcttccttagaccaggcagggctgccatggtgctagctgcaagtccatcagtattgaccgtctcgctccatcttggtcctccggagtcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaagccttgtctcctttcctttggagctggggcccgagccctcccccagcccagcggcattagccccattggctctgggaagagcctgacctgaggtgagcctgaagccagggaacaggaaacctcccagcgcctgcagtcatgatgaaacttctggggttccagacttcctcagcctgctgaagcccctcaggccttgttaaccctgatctgtgagcagtgctttccccctcttcacacagtgggcctggcctccagaggctcaagttagcacccaggatgtattccaggaccctgctcttccagtctcagtccacagcagtccatcaggagcaaaggagaaatggggcatgttctcctgggagatgagtgtagctcaggaaaccgtagcaaccttctcatcacttgacatccagaacccatggggtggaaaacacttcgggtcccatccgtcaccccccactcttcctctctgttgtccctccagctctggacctcttcccacactttcagacaagcccaaacagttgaaaccagacttgcacagaaaatatcttttggatttcacagcatatttcacccataacccttcctgcccttgtctcagctctcctttcattcagcttaagggtaaaacccagacctgtgagagaggaaacagtgtatttcttacttttcatcccagccagtccccacaagatcgtggctagaagtgtagcttcgcaccgccaagaccccctcattttcagtggtgtggtagtgaccaggggaggaggaggcatggcagcaggaaaaggagaggtgacccgcaggaatccatagacatctgggactgtacaccagtaaacggaggcagttttgttacaggctcctttaaatccagctaaagcattacccaaaaaaagcacttcaaagtaaccagaatttatgaataccttgcattgcacaccctttcatagacgcagtgttgtaattttcatatttaagtccagctgatatgataccaagtaaagggcctcaggcttcaacaagacaggttcatacacagtggggcccctggcctgctcttgtacaaatgaggggctgggtaagtaagtgctggggtgagaatctacgtaatgagtcaggtaggctctttgtggacactggccattttcttagaaagcagaaggaaatgtcattgcagactcctggaggatcagaacccgacctgcttgggggtggaaggggttacctcatttcctgctgtcccattcctcaggctcacagcacgcacctgcctaatttaggcacctgactaactgggttagacctttgggtgcaggtggcccttctcagaggcctgacgatgaaggggttgaagctctgctgccccatttaccaggagctggcatttggaccactaccgtggaggtagtgacaggaagcagtcataccaagaaccaagcagaatggcccagaagcaggctgcctgtaacccttagtgtctgccagcaaggtgaggggaccagctgttgaggcctggcagaagatgaggagaggccacgtcaggtcagctggcaggtcacctctctgagccccgtccaaatgacaatgtgcacacagatatacaaactttttccaaccctgagcctgaaaggacttggttgttggaagcacaaaacctccaagaattttaagtgtaggctctgttctctccacagcgagctgaggcttcaggccttagggtcataggagctgactggggatgggacagaagtgcagagttccctccacaacccatgaagtccacattctcttgcttccagcagatctgcaccctcaccaccatgctgccatctggctggcccatacctggaacagtcttgtctagcacatttgctcaggagggagaggagaggggatggaccagagtgatgggagcccagggctgcagggcagctccccctggtggaccctagaggtggcccctcccactcctgggagaagagaagccacactgtgcatttcgcagccaatcaaaacacaaccctccaatagagggcggaatggggttaccagaagctgggaaaagcaggggaggagaatgaagagcaggtggatggtacaaaaatatggtgaggactaagttctagtatttgatagtacagtagggagactatagttaacaatttattgtatatttcaaaatagctagaagaattggaatgttcccagcacaaggaaaagataaatgcttgaggtgataaatgtccttaaatatcctgactggtcattacactttgtacgcatgtatcaaaataccatatgcagccccaaaatatgtacaactatcacatgtcaattttaaaaaggaaaaacaaaacaaccagaacattcctctagttagtagctacaacagggcaggaactggagagaaaaacaaaacaaaaaaagcagcagcctcctgactggccatttcccttcttggtctccagttaaaagctgcctctgagctcccccagccccaggcccccaccaccagcctctgccttccaagataacctgtcttgcctgatcctggaaaggcttgtgagaaacttggggtggtaagaaataaaccaaaggagattctcaaattctatctctgggatttctgtttcctcaggtgtaaaggtagaatctgaacaccacctaaactgccaccacacagtgccactgtctttgctagctgacgtggaagtactgtgcaaacttaacagaagtgctgtggagatgctaactgactgaggcaactaggaggaaccctccctgccaggaagaggttcttggggatatacctcaaagcttagggctttcaaatacttcctagccaatgggcccaactgtccagcctggctggggtaacgatctactcccaactcctaccaataattctctggaattcttagcacctttttcttgccaaagcccaaacaaagcaatttcagatctgaaaattcttcacaagtagaagtgattattaactttaatttctatttcaccaaggaatgtgaactgaaatacagagaggttaagtaacttacctacagtcaccagctgaacaggccaagaggacaaatgatgtttctaattcctagctgagttttctttcttttcttttcttttcttttttt

SEQ ID NO: 9289 - DNA, 2858 bp, Homo sapiens
gatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaacggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaaggtgagttcaagaaagctacctgtggaaaatggaccaggttgggggggtgattgcaaagtctccccaaagcctggctcctcatgctcagtgccaggggcagaacactggggagccaggtatagagagccttcctgtcataactgccagtcctcttcctccaaggcctctgcatattctcatgttcccctcacccatcatgccagccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggagtccgtctcattctggctggtcgagtgaccagaggcctgtgtgaatgtgtgcacctgcttttcctgcctggaatgttttctggctcagctgcagcaacatctgtgagcccagtgtctgccctgtgtccctgggctcgctccaagtgcaggaacatacatgcagggcccaacatgatgatggtgtgaagggcaggaaacagtcctctgaaggagtggggaggtgggcagtctgcccccgccaggtaccatcgcctcctgccagcttccttagaccaggcagggctgccatggtgctagctgcaagtccatcagtattgaccgtctcgctccatcttggtcctccggagtcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaa

SEQ ID NO: 9290 - DNA, 973 bp, Homo sapiens
cagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggc

SEQ ID NO: 9291 - DNA, 973 bp, Homo sapiens
tttgagatggagtttcactcttgttgtccaggctggagtgcaatggcatgatctcggctcaccacaacctccgcttcccaggttcaagcaattctcctgcctcagcctccaagtagctgggattacaggcatgcgccatcacgcccggctaattttgtatttttagtagagacgggatttcttcatgttggtcaggctggtctggaactctcgacctcaggtgatccacccgcctcagcctcccaaagtgctgggattacaggtgtgagccaccgcacccggccgctaagttttctttttactaaatcaattgaggggatcgcaacccaggtagtgcaatggaagcaaccaagtggctttaaatcaatcagattctcagagactgattcagaggcctggtgtgggttctgggaacctgttcaggtaagacagaaaaccagatctggtttcagggctcccagtgggcatgtgggcttggctggtcttactacatagggaggttggaagacaaaagcaccaacagaggtaggcctaggaaggaagagacatttttccagcgacagatggcccactgctcagccctggctccagaatgcaaaagagatcagaaatagatgctcagcaagaggcatgtgccacccgcatcatgtctcatgcagctgccatagctttaatcaggaaaacacacatcttatcccactttgcacagaccctcctgaagtgcagaagatactaggaggaggcatggggggagcagatggaggaagaatgaaaagcagtccaaagaatcattctctcacttgggaaggacagaagaaagctgtaccccagcagtgtcaaggcaggaggcttcactcaagccctgttcctcccaggcctcacagcagtgggaatttacctcagctaatagagggagatcttacaacacatttctcaatctagattcatgtcttgagaccccaccccaagatca

SEQ ID NO: 9292 - DNA, 973 bp, Homo sapiens; identical to SEQ ID NO: 9290

SEQ ID NO: 9293 - DNA, 3500 bp, Homo sapiens
cctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcaggtgaggggcggcctggcaggcagtgctggggacccagggtggggctgaggcagtccgggccctaacttggtctcctgcttcttcttctctgtctttcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacaggtaggtgtcagatcaacccagagcagagtgagttgggggacccaggggatgggctccagtcaggcctggctcagcaaacaattttctccccactagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggtgagcgcctgcaggccgtggggctcccactgccacttggctgtgcctctccattgacgtctttgcttttctgtcctactcttctttccatgcctgtgtgtctctcaggttaaagggtcccctctgtcccttctgcctgcctgtgttgtctcctctcccatctgaggcccctgtcttggccttcctgaggccgtgtgacagccttctcaaggggtctgctgggcgggctcagatccaactctttgtttctggcctttgccccagagtctgagctcagtgttcgccatctccctgcccatctccaccccaggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaagtgagcatgggctggggccttggtggagcgtgttagggtggcgggagtgggagcagctgcaggctgaggcgggggaggtgaccctgccggccctccagcagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacgggtaggcgagcattgggcacccagggtccttaggtggagggcagactggggccacctgcactgagtctgcttctgtttggccagacctggattcagcacccgaggaccccacctcgcccaagcgcaagatgagaagacgctccagctgcagctcggagcccaacacccccaagagtgccaagtgcgagggggacatcttcacctttgaccgtacaggtgccgtggtgggcagaactttgggggcctggggacctgcaagaggagtgggtctctggaaggcggttagagagtgagagaggtagggtgggtccatccaggctgggaggaagcacagcctgtcagtggtgggttctggagtctggcaggcccctaggttgccctgtgactgtgggcaggacccctctctgactcccctgtgaaatagaatgcagtgagggcttgggtgggcactcagacggtggcaggaaggccctgccgctgctgcagccttgccatgctgcctgtgccctgcacaggtacagaagccgaggacgtgcttggggagctagagtatgacaaggtgccatactcctccctgcggcgcaccctggaccagcgccgggccctggtcatgcagctctttcaggaccatggcttcttcccgtcaggtgagcctgtctcggagtcttggggtcactcgggtgggacttatctgtacatctcatcctgtgctccccaccgtttttctatctccagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacacctgtgtg

SEQ ID NO: 9294 - DNA, 632 bp, Homo sapiens
cagctgcacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacaattgtgtg

SEQ ID NO: 9295 - DNA, 174 bp, Homo sapiens
cccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaag

SEQ ID NO: 9296 - DNA, 13789 bp, Homo sapiens
cactgaggaaggagagtttaatgttgtgggaaggcagcaggatgcttagggtgcgggctccagcaggggagcaccttggccctggtcttgggccagcagacgcagaagcagggagtgcagagcccggcaaacaggtgtgtagcccaggcggctcagatgcaggtaatcatacatgtcatgatggctgatggtgccatctgagtgcacaaagccagggtcggcatctaggaagtgggcccgagggtggccagccagtgccgcccgtaccagctcgttcacctgtcggttcttctcccgaagtgggttgggatgttggcctcgcggaagcaggccctgagcaggaacacgaggcgtagtaaggaaacaagcatttgagtatcttgttctctgtgccaacctgtcctccacccaccaccatgaagtttccagctgcagaaaacactagggatgggcaagtggggagggtgggagggtagttcctaaatatcacatcctagccctcatttagcaagagacttctgggttttaccctctttcgttttcttttttttttttttttgagacagagtcttgctctgtcgcccagactggagtgcagtggcgcgatctcgactcactgcaagctccgcctcccaggttcacgccattctcctgcctcagcctcccaagtagctgggactacgggcacccaccatcatgcccggctaattttttgtatttttattagagacggggtttcaccgtgttagccaggatggtctcgatctcctgacttcatgatccgcccgcctcggcctcccaaagtgctgggattacaggcgtgagccaccatgcgcggcctagcctctttccaagtatcacttagaaaaatgttgacattggctaggttcagtggctcacgcctgtaatcccagcatgatgggaggcagagctggataggtcgcttgagcccaggagttcgagaccaacctgggcaacatggtgaaaccccatctctaacaaaaatacacaaaaattagtgggacatgatggcgtgtgcctgtagtcccagctactcgggaggctgacgtgggagaatcacttgagccctggaagcagaagttgcagtgagctgagatcatgccaccgcactccagcctgggcaacagagccagatcctgtctcaaaaaataaataggccaagggaggttgctcacgcctgtaatcccagcactttgggaggctgagacgggtggatcacttgaggtcaggagtttgaggccagcccggccaacatggtgaaatgccatctctactaaaaatacaaaaattagccaggtgtggtggcacgcgcctgcagtctcagctactgtgaaggctgaggcaggagaatcacttgaacccaggaggaggaggttgcagtgaggccagattgcgtcactgcactctggcctggcaacagagcaagactctgtcccaaaataaataaataaataaaagatatcaacatcatggctcatgccaagggatcaatccgttttcagaagaggaaatatcctagctacctacaagtgatggagcctagatttaccccaggaatgcctgacaacttttggcctattcaaggttttttgagggtttttcttttgttttctggtgagacagggtctctgtcacccgggcgagagtgcagtagcatgatcacagctcactgttaccttgaattcctgggctcaagtgatccttctcctttagcctcccaagtagctggggttacaggttttgcgcaccatcatacccagctaattctttttttttttgagatggagtcttgctctgttgcccaggctggagtgcagtggcacaatctcggctcactgcaagctccgccccccgggttcatgccattctcctgcctcagcctcccaagtagctgggactacagacgcctgccaccacgcccggctaattttttgtatttttagtagaaacggggtttcaccttgttagccaggatggtctcgatctcctgactttgtgatccaccctcttcagcctcccaaagtgctgggattacaagtttacaggcgtgagccaccgcacccggcttttttttttttttgagacagagtttcgctcctgttgcccaggctggagtgcaatggtgcaatcttggctcaccccaacctccacctcctgggttcaagcgattctcctgccttagcctcccaagtagctgggattataggcatgtgccaccacgcccagctaattttgtatttttagtagagatggagtttctccacgtgtggtcaggctggtcttgaactcccgacctcaggtgatctgcttgcctcggcctcccaaagtgctgggattacaggcatgagccactgcgcccagcccatgcccaactaatttttttttttttgagacggagtctcgctctgtcgcccaggctggagtgcagtggcacagtatcagcttactgcaagctccgcctcccaggttcatgccattctcctgcctcagcctgccaagttagctgggactacaggtgcccgccaccacgcccggctaatttttttttgtatttttagtagaaatggggtttcaccgtgttagccaggatggtcttgatctcctgacctcgtgatccacctgcctcggtctcccaaagtgctgggattacaggcgtgagccaccgtgcctggcccgttttttagtttttcaatacccccaaagtcttaagccatccctgggcaaaaaaggctaattggtctcggagcatattctcaaccacagccactctgaagggtatagcaagctccaacgtgagattctgcctaaaagccactgctctatgtcaagctgcctagaactgtgccaactgtggctatatctgagggggtcccagaccactgccattcttcctttcccactctcccagcctctcaccagcaccacaacccgggcctggggctgtcgctcattcaccagttgcacaatggccttgatgccaccagtcacctgctctgctgtgtgtccgtggttgttggtgcccacccagaccaccacaatctgtggaaaaagagacatgaagcagcggtgagggggcagccaaaagatgttttagagccccacccaagccccgctcaccttgggccggatgtgttccagctccccattctccagccgccacagtacatgctgtgtgccgtcaccaccaatgccaaagttaagtgcatgcagaggagagaagagctcgcgccagatctgtgggcaagaagtggtgtgggcaagaagtggtaggggcacaagggcactgtccgcatggaccatccccctctgtccaggtgttaaccaaatgccattatggaagaaccttacttcatggaagcagtcttaaaattttacctggagcaaactccagcatggctgaacctcactttatagaaatctattagagtctctcacttattttattttattttatatttttgagacagagttattttatttttgagacagagtctcactctgtcacccaggctggagtgcactggcactatctcggctcactgcaacctccgcctccctagttcaagtgattctcatgtctcagcctcctgagtagctgggactacaggtgtacgccaccacgtccagctaattttttgtatttttagtagagatggggtttcaccatgtgggccagactggtctcgaactcctgacctcaggtgatccacctgcctcggcctcccaaagtggtgggattacaggcgtgagcccatggtgcccagcctatttattttttgagacggagttttgctcttgttgcccaggctggagtgcagtagtgcgatctcggctcattgcaatctctgcttcccaggttctggcgattctcctgcctcagcctgccaagtagctgggactataggcatgtgccaccatgcccagctaatttttgtatttttagtagagacaggatttcgccatgttggccagggtggtctcgaactcctggcctcaggtcatccgcctgccttggcctcccaaagtgctgggattacaggcgtaagccaccacaccctgcctagagtctctcactttaaaccaagccccaggctctgttgctcatgctgaggtgggcggactgcttgagcccaggagttcaagaccaacctgcgcaacagggcaaaaccccatctctacaaaaattacaaaaattagccaggtgcatggtgatgtgcacctgtagtcccagctactcggagactaaggtgggaggatcacttgagcccaggaggcagaggttgcagtgaacagagatcataccactgcacgccagcctgggtgacagagcaagaccctgtctcaaaaaccaaccaaccaaccaaccaaccaacaaaacaaaccaagccccatagaagcaagactcacttcatgaaaatccagtctgcttgagccatgcattgaatcaatggcattacagttgaaacttattttgatgaaacccattacagttggacatgctttgtggaaagatattattatgattgagtcctctttgtggagtgccattagagttgcccttcgcttcctgtaaagtgactatagctttgtgtaaacccaacagggctgcgcactacttaaagcaaacaagaaagagcctcactttaggcaagcctatggcaggaaagcctcattttaggtcttagtacattatacacaaatccaatctgataaaaccaaggcatacatttctttctcaatagaatgttgcaccttacaccaagattctcagagcctcgggctgcctgaggccaatctgggtactctcataatacctcacctggcctgggttctggtccagatgtgtcagcatggacacagggctggatggggcagggggagagggactgccctcacctcgcactggtgcatgagctggaccaaggagtccccgatgaagacgacttcgggttccttatctttgctgtcagccacgaaccgatggtgctgcgggagcgcgcgagagggagtcaatggcatgcacgctccagggcccgccccgccctgctcccttaggcagcgcctcctcaactgccctcagtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgcctcctctccagggacggaagccttcacttaggaggtaggtggaatcaggaaccttcgcttcccccacgacggccgcacagtgggctcgcccggcgcttcccgctcgggccgctgactcccaggccgcgcacccggcacggggtggggggagggagaggcgagaccatccagctcccgaggcggggaggagggagaaaccacccaccggtcacggggaggggcgaactacctgaagagtcgagagtgggcggggaaaatctagccctctgtctagcaaatgggaagaaaccatttgctgtacagagtgaaatgtgcggaagggaccacctactgttgcgggggggggggtgacccattcacgtggtggggggaggggagcgagtggacgagtccattcttatattcccttgaaggggtggctcgaatgcacctggctgggggggacgctcctattttctactgatgtgggggacagaaaaggaagatgacaaaatgtgaaaattcgaggctcccttctaaggagccactctaaggccgcgccagggctttagtgagcctatctactcgtgggcttcccctactcaaaacaccgtgggtgtgtgtgtgtgtgtgtgtgtgtgtgtgtgtgtgtgtgtgttgaaatctaaagtacatatctttgcattcaagacatcacaggacccctactcaaaacaccgtgtgtgtgtgcgcgcgcgtggcataacatataaactacatatctttgcattcaagacaccataggacctgcttggagggtagaagaaggtgcagaaagagaaaggaaattagagacgcctccagggctcaggtccagtctggcgtccctccggcagatcatcttgcagatctgcagcctctacactctctctaaacccacaggccaactgggtatgtctgagctctgaaacctacatccatagccaaggccacctagggtcgcgcctctcccccaacgctgccccaaattaatctcagacctcagtgtcttctcagatctccctcttctctgggaccaggtggggggctcactccctgctaaacgtcctggtcatgttcttgtagcctcactccaggtgggaccttcccatgtattcattccttcgaggtggattgatactgagacagagatgagtgttattcattgtgtttatgttttcaatccactttcctggaactgggccgggcacacagtggttattccacaagtgcttgctgaatgagtagtaaatgagtgggtcagctcctgaccttgtcccaatgtgtttagggagacagatccagacacagaggtgtaggggtgtcaaagttgtgtttgagggagagacagggacctctggggaggaagaggagaaggactctgaggactatgggtttcctaggagtagtatctcagctgggtctgaaagataatgaagaatgggcaagcagaaagaaaagacacaggtaatcactttcttattaggtttggggaatatcgtggaatagcttgattttaaagtctgagggaggccagcatggaggctcatgcctgtaatcccagcactttgggaggctgacatggtcggatcacttgaggtcaaccagcctggccaacatggcgaaaccacgtgtctactaaatatacaaaaaaaaaaaaaaaattagctaggcatggcagcacacgcccgtagtcccagctacttgggaaggctgaggcaggacaattgcttgagtctgggaggcagaggttgcagtgagctgagatcgcgccactgcagcccagcctgggcaacagtggcccagcttgggtgacacagcgagactctgtcttaattacaaaaataaacaaacaaataaagtctgagggagccaggtgcagtgatgcatgcctgtagtcccagctactggggaggctgaggtgcgaggatcgcttgaacccagaagtttgagaccagcctgggtaacacagtgagaccctgtctaaaaaaaaaaaaaaaaaaaggctgggcgcggtggctcacgcctgtaatcccagcactttgggaggccgaggtgggcagatcacgaggtcaggatcgagaccatcctggctaacacggtgaaaccccgtctctactaaaaatacaaaaaattagcggggcgtggtggcaggcgcctgttgtcccagctacttgggaggctgaggcaggagaatagcgtgaacctgggaggcagagcttgcagtgagccgagatggcaccagtgcacttcagcctgggagacagagcgagacgccgtctcaaaaaaaaaaaaaaaaaaaaaaagggcaagtgcctgtagtcccagttagttgggaggctgaggcaggaggatagcttgagcctgggagatgaggtggcagtggcccatgatggtgtcactgcactccaggttgggtgacagagtgagtccctgtctccaaaaaagaagtcataatcagctaggcacggtggctcactcctataatcccagcactttgggaggctgaggtgggcagatcacttggcgtcaggagttcaagaccagtctgaccaacatagcaaaaccccatctctattaaaaaatacaaagattagctgggcaaggtggtctgcgcctgtagtcccagctacctgggaggctgaggcaggagaatcgcttgaacccgggaggtggaggttgcagtgagttcagactgtgccactgcactccagcctcagtgacagatttaaattccatctcaaaaagaaaaggaaagaaaagaaaagaaaagaaaaaagtcttaattatgccttcaagtcagtgatataagagagaattttttttttttttgatagagtctcgctctgtcgcctaggctggactgcaatggcgcgatctcggctcactgcaacctctgcctcccaggttcaagcgattctcctgcctcagcctcctgagtagctgggactacaggcgtgtgccaccacgcccggctaattttttgtatttttaatagagaagaggtttcactgtgttagccaggatggtctcgatctcctgacctcgtgatctacctgccttggcctcccaaagtgctgggattacaggcgtgagccaccatacccaaccgagaaaaaaatttttaaaaataaagtcttagaggataagttggagcagttcctgaagcaaagcttagtgagaaacaaagcttccaggcattcttcattcaccaggcccatttcaagttagacatattggtctagtttatccttctagcaaccaaatgaggaaggtagttttattaccaacccaattttacaggtcagaaaactaagtctgaccagttacaaacatttccaaggtcacacagcccagttgtgccattttgggcatttaaaccaagcctagctatgaatcacaacactacactaacttttttttgagatggagtctttctctgtcacccaggctggaatgcagtggtgtgatctcggctcactgcatcctccacttcccaggttcaagcaattctcctgccccagcctgctgagtcgctgaatatacagtcgtgagccaatgcatgtggcctaatttttgttcttttacagggtcttgccgtctccctcaggcgggcgtgatcatggctcactgctgcctccacctcctaggcttaagtgatcctcctgcatcagcctcccaagtagctgggcccacaggcaagagccactgcgcccagcttatttatttatttagagacggagtctcgctctgtcgcccaggctgaaatgcatctcggctcactgcaagctccgcctcccgggttcacgccattctcctgcctcagcctcccgagtagttaggactacaggcgcccgccaccacgcccggctaattttttgtatttttagtagagacggggtttcaccgtgttagccaggatggtcttgatctcctgacctcgtgatccgcccacctcggcctcccaaagtgctgggattacaggcgtgagccaccacgcccaaagctaatttattttttgtagtcagggtctccctatgttgtccagggtggtcttgaactcttgggctcaagccagcctcctgcctctgcctcccaaagtgctgggattacagacgtgagccaccacgcccggccaactgtataagttttctagggattatgtctgtggctgcttgggggacagctgtgcatgggggctaccatgacccttcttccctttggcacgcctggtctcaactagccctcgaaagaccgctgatagctatctgaaccaatcagcattcaggaagggggcggacctagtgaacctcacagccaattgagggctgggaggtgctgagaccaagaaagggagatttctgaaattgaggctgggaggggaggggctataaccggcgcttccctggcacgcgccgctaggtttccgtcctctcagagccacgaagccaaagggcatggaaagggcacgcgcatgcgtgtgggggagcccgaggcccggaacagcgccaggtgacttcgagagctggggtcaccgcggaaaagaagccattgcgccccacagctacgtgaagtgggaagggccggggttcgttggggcgagagaggtgcccttcccacaccctgctcctgccaaccgtaccccactcccttcactctgcccaccctgccctaccgcggctggccaccatgcttcctctcctaccctaggcccttcctttgtgatcaggccctgtccctgatcgcgcctctgtctcccttcctgttctcttgaggttttctcaggctttccagacttctcttgctgctctccctctcctgcttctctttctctactatctctttccactttctgcattcccctgtacctcgtctacccctggatttctccgtccagaatcactttctggtcccccaaatccctccaatctcatgaccccttcaccaccctccatcttttgttgttgttgttgttgttgttgttgttgagacagagtctcgttgtgtcccccaggctggagtgcagtggcgcgatctcggctcactgcaacctccgcctcccgatttcaagcgattctcctgcctcagcctctttgagtaggtgagattacagtcattcaccaccacgccggctaatttttgtatttttagtagaggcgaggtttcacatgttgcccaggctggtctcgaactcctgacctcaaatgatctacccacctcggcctcccaaagtgctgggactacaggcgtgagccactgcgcctggcccccaccctccatcttttttttttttttttttttttttttttgagatggagtctcgctcggtcatccaggctggagtgcagtggcgcgatctcggcccactgcaagctccgcctcctgggttcacgccattctcctgcctcagcctcccgagtagctgggactacaggcgcccgccaccgcgcccggctaatttttggtatttttagtagagatggggtttcaccgtgttagccaggatggtctccatctcctgacctggtgatccgcccgcctcggcctcccaaagtgctgggattacaggtgtgagtcaccgcgcccggctcaccctccatcttttaactgtttccccatgtccctgttcctaatagcctctctctgtttcctggcttatcttcccattagctgtgactccttcgacttcatcttacccctgtgattccttatctgaccaaaccttttccaatctctctctgctcacttattttctctcatcttctctctctcttttaagagacaaggtctcactctcttgcccaggctggggcacagtgatgcaatcatagctcagagtaacctccaactcctgggctcaagtgatcctcctacctcagcttccctagcagctgggactacaggtgtgggccaccgaatccagcttttttttttttttttttttttttttgagatagagtctcactctgtcactcaggttgaagcgcagtggcgcaatctcggcttactgcaacctccgtctcctgggttcaagcgattctcctgcctcagcctccagagtagctgggattacaggcgcgcaccatcacatacagctaatttttgtatttttagtagagacaggatttcggcatgttggccaggctggtctcgaactcctggcctcaagtgatctgctcgccttggcctcccaaagtgctgggattacaggcatgagtcaccacacctggcatcatccagctaatttttatttttattttttgtagagatgagggtctcactttgctgctcaggttggtcttgaattcctagcctcaagcgatactcccgcctcagcctcccaaagtgctaggattacagatttgagccaccatgcctggcctcatctggtcattctaaatagtattcccaccacaccccaaaacatctccctattcacttgttttgttttgttttgtttttgagatggagtctcactctattgcccagactgaagtgcagtggcacaatcgtgactcactgcaacttctgccttctgggttcaagcaattctcctgcctcagcctcctgagtagctgggattacaggcgtgcaccaccatgcccagctaattttttttttttttgagatggagtcttgctctgttgcccaggctggagtgcaatggcatgatctcagctcaccgcaacctccacctcctgggttcaagtgattctcctgcctcagcctcttgagtagctggaattacaggtgcatgccaccacgtctggctaatttttgtatttttagtagagatggggtttcactatgttggccaggctggtctcgaactcctgacctcaggtaatctgcctgccttggcctcccaaagtactaggattataggtatgggccactgcggctggccaatttttgtattttcagtaaagacagcattttgccatgttggctaggctggtctaaagtgacctggcctaagtgatcggcctgccttggcctaccccagtgttggtattacaggcataagccaccgcgcccagccctccctattcactttgctactccccttgacttatctgcatgctgatggccaccctatctttatattccaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggtgagcgtccctcctgcccctgtactcccctttcctttgtcggctctagctcagctagcctctatgcttctttcctctgtgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtcctcttga

SEQ ID NO: 9297 - DNA, 2804 bp, Homo sapiens
gaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaac

SEQ ID NO: 9298 - DNA, 7695 bp, Homo sapiens
acaaacctgaaagtatcactgtttatttcacatttaaaaaaatcatcggcagaaactaggtagctgtgaaaatagaatagtccactggtagagtttcaattgtgcaaacagacgtttggtccatcatttttcttctctgaacatttcttcatctgcaaatgggggagtgcctgtgcaggtgacaacagggtggtgaagggccacccttaaacctgctgcagcccttacctttcacatctgaacaggcagactcaaacttcattgggtggccacaaagacttggaagctcaaaatttgaaacatcaaaattaaacacagacccaatttctttgcatttttagtcctgtattctatgtttgacaaaatcactgtaaaataaagcagcagtaagaaaagaagcagattcagaggactaaaagcaggaacagatgggaaaaaaaggctggaaatccattcgtttatttactgagcctggtccaatgtcaacagaactaggattaactaggttaagagttggcaaaggacaggaaagcaaagtaataaaatttaaaagctgaattggtacagtgttatgaagaagtgtttatttagtatttatagtaccagattacagtcacttgttgatttagatatgaattttcatatgttagaagactcagggaaatacacaggatcccaaggagtgagactgagattctgggtcttattagctgtactttgggtaatttacttaaccctctctcagcttcagtttcctcaaatctaaattagggcttaactaatcattatgtcctttgtaagactggaaatgtggattagcagttagacagtatgtatgtacccagttttgtagatatgctgggacatagtaggtgttcaataaattatacatatacctgaataaacaaactatacataaatattttataaattatacatataatcgaacatcatttaggtaaactctttaatgaaagacatttattgtcagattataaaatcagtgttgatgataagccctcctacccacaaaacaaaaatcgtatgtatgaaattccctttcccgtaagttatgtgcctgtcagccatcccacttcagtccatctttggatgctgaggctctggttgccagtccttatctctacacctgtccctggtctagaggagaaacgaaggtgctctgaggcccctgtaacagagacccttgtcatccatatttgcaataaagacatcatggaggctgtgcaaaagtatccttctccccaacttctgcaggcaccatttccatctcactacccagaggtacatcagagagcaggagccaggcaggtgacaaagatgtggaaggcttctaagtggttggctttgccgtctcagaagtgcgaagaaatgaaaatccatcaaaacagaatgccattccatgtttcaggcttttacctcacctcaaatcaaatgtctgttctttatttattggtcccataagtagacacgcacttggacttctggttttagaacattctattgttatcctttctccttttaataaacacacactagtttcgaggaatctccctaataatcctggcctgacatgctgcagaacttcaatttcataattttactaacaacagaggaatttcatcttattattaccaactaccacattaaaggatctgaaacagtaattcatgcataattctatttaataatggttttcaaagtactttgctgtttgaaaatgcttcccagatgattctgatcggagagttgggaaccactgccctagactgtaaccactcaattgaactttactcagtgctgcttccctgcccacttcaagtaaacaatgcttaactttttcgtttctaaaacaactgagattactttctcccccttagtttctacaatgattgttgaaaatttgtgggaaaagtttatccttacaaatgaaaacatgaaatctgaagtggataaactaacttttaagaaatacatatccttactcagtaagctgaggcaggaggaccacttgagcccaggagtgcgaggcttcaatgagctatgattgcaccactgcactccagcctgggcaacagagcaaaactcctgtctctagaaaaaataaatacctatctttcaaaacttgcataaaaagcccttgtcttcacttgtacagcctcttctgtttcatgaatgagcatgctgaagggctatttactctcctatgaaaaaatgttgttacagtaaatgacaagtgttatgaacacaatgaacctggtgtgttagatgttaagtgtgctgccaccccatgtgaacctccaagtgaaactgctcacataactgtttttttgctgcatgcaaacctgctaatacaaagcgggctcctgacttaaggacagccaatccctactctagacaatgacccaaccagacctagtataaaaaggtagtctggcccagttaaattcccttggcaattggagactagcagcaggagctgaaggtcatcatgtagaaaagaacctcaaaggtgcaagttaaagttattacaaaggaacagaaactgtaagtatgcaaaagctgtgtagagaagttggtgaatagagagaatggagttaacaatgcaaaaagaagcaagtcacatgcatgcagagcccaagcctaaacatccaccttcccctgctgaggagcaccacccaatttctactcttcctgaggctgggaggtgatttctgagtgggagatggggttggtgaggtggttcctgaattccctggcacatatccttgaaataatgtcacattgcttgagctaacttgtagcttttgagtctttttatgtttgtcccacttgagattccttgcaactaaaagagcataactgaaacaactagttaagccaataccatttgttaaaaataatgcaccattctaaatttctgtttccctaaccaaatctggcaaagtctgatccattaagttttaaaacttttctaagtttaatgttgtcactgtatgtttacgtattcattggtacaatttacatcaagttttgtacttatccatttttgcaaagatatgtacacaaagatacatatccaataactgagaaacaagtgaaacttctgatctatactttcaggtttgttcgatcatgatacttctgataaggatcatcaacgtaccagtttcgcctcttccagaaggacgtcgtcattttatctaagagtttactctgggttttattgcagaatacaaattccctcaatcgcttcttccttgcaggtgtctttttccataattttttcttatagccagcctgtcagatattacaaagaaatgtaaaacatcatactatgtatgaaacaacaggtatcttcacaactcaaggtttatagacccaataagaacaaaaaccagacttccataggggctggactatttcttggaaagatgtgattctcaatggccgggggaagggagggtggcggggagggggatggagaaagcatgtgtagtttaaaaaagaattagtaataaatcatattttagaaaaaaattatttaaattaaactcacagaaaataaaactaaatgtgtgtggctgggaaagtacaagataatgacagaattataatcactaacttaacaggtatgatcttactatctcttcagcaatctttaacaacatactattattctattttacatctttaaaaaaagaaaccattgattagagaagtagcagacagaggtctgagggctaataagagttctttttttgtttcattttgagacagggtctcactctgtcacccaggctggagtgcagtggcatgatcacggtcactgcagcctctacctcctgggctcaagtgatcctcctgcctcagcctctcgtatagctgggaccacaagtgtgcaccaccatacccagctactttttaaatttttgtagagataaggtctcaccatcttgcccaggctaataagagttcttaaccactgtctttcctaatgtagaggaggatggagtgcaggcgaggtaacaacattaatatttattaaggaggctgagtattacaagagctgagaagcacagttctcaaatatattgcttcatttattattttcacacacaagggaccaatttttataggaagtacttttctaaggaattatgaatatggtaagactattattaggagtggtgaaggaatggttaacccacatatttaacccagaactttcatatacacccatacaggtattattcattttgaagaatttatttttaaagacaggaaaggaaaatttgattgattataaaaactataatcatagcctgtttaaactagaagggatcttaggtgccatccagcttaattaacatctggctaaaaccacacggtgagcccttgggtcctttcaagccaagggctctttatggcacaataccaactgaacaaaaccatggctctttgccgagaatgtgccttgcatttctgacatgtcttagtatcatcactgtgaccatcaacttctataaggacagtgatgaaataaggaaaggttatttaagagttctggttttagaatgctagaggttagatttttgctactcactgcttacaattttaaatgcaaacatttaaagccaaatctccacatttgtgtaataatttcatagtttgcaggccaaactgggttactatggatctctgacgtacaaacacctaatttattgccctgctcattaccaccagtatcctttaaagattattcacagaatggaaccactatgaaaatgcttgaaattttttagacaatctctagattcaaaaatggaaggagggaatgaacaataaataccaaggactgctggatgaaaccgtgtcatggaaaatactttgttttacacattagtttgaattcatctacccagattttttttttctctgaaaattagattttgaagaggcagggcattctatacagggtatactttcgggagccctgaactgaagctaggtattatgactggagagtatgatcgggtcctttacagtaacatgagggccccagagcccagtaagagggacatggaaaggaaggcaaggaaacccacccatttcattttacctagggctagaagaggacctggaaataactggtataaaaaccaaagggtggggctaggcgtcacggcccatgcctgtaatcccagcactttgggaggccgagacaggtggatcacttaaggtcaggagttcaagaccagcctggccaacatggtgaaaacccgtctctactaaaaatacaaaaattagcctggcatggtggtgcatgcctgtaatcccagctactcggaaggctgaggcaggagaatggcctgaacccgtgaggcagaggtcacagtgagccaagattgtgccactgcactctagcctgggcgatagagtgacactttgtctcaaaaaaagaaaaaaaaaaaaacacatacacacaaaagggaagaaatgtttccagtggtctcaaattcacaaaactcagaacattagacctttagtttagctgctttatggattatatgagcttctgctgactggtgtaggaaactacccaccacagtgtttcaatagagaaatgagctgagagttccaaccaacccatttatctactaatttagtactgtttataaaacgggagaatcctttcaacctttcaaacatcaagaaagttctaccaactattttatttttacagggaaccaaattttgatttttaaagatttaatttccaagtaatgaaagggaattaggatttgggcagttactaaatctcaaaaatggttttgcaaaactggtcttaagctgctttcttttcattttttgagatgaagtcttgctgtgtcacctaggctggagtgcagtggcgtgatcttggctcactgcagcctctgccttccaggttcaagcgactctcctgcctcagcttcccaagcagctgggattataggcacctgccacaacgcctgacctcaagtgttctgcccgccttggcctcccaaagtgctgggattacaggcatgagctacagtgcctggctgaattctgaattctgtttgattttaatctgctcacactccttttttcttttcttttttgagacggagtctcgctctgtcgcccaggctggagtgcagtggttcgatcttggctcactacaacctccacctcccgggttcaagcaattatgtgcctcagcctcccgagtagctggaattacaggtgcctgccaccacgcctaatttttgtatttttagtagagatggagtttcaccatgttggccaagctggtcttgaactcctgaccttatgatccacccgccaaagtgctgggattataggcgtgagccaccacgcccggcctcacattcctttttcaatttagtaacagtgtgaagactcacctttctcctcacccaaaggccacaatgaagtcgaagaaacctatcgatgacagctttcacggtctttctcttgccttttcttgcactgaagtatgttagagatctgactggcagcttcaggacacttggaagcacgggggccattctaaaaatatattttaaaatttttagcttgtaatcagactgattaaaggattaaaattcattatctatactgagaaatgagtaaagctgctccaatggactggaactaacttttcatatacaatattacttccaatgacccatgacattaagcataaattagaatagcaaccatcaccaactcgcaatcttctaaaacctaccccctcaatccctgtaaaataattcattctattatcatcgctttatttcttatccatcttcccaccagattgcaaactccttgaggacttcaatttgtttacccttatgtcctttttgccaagtacagtgctaggcacccaggggtatttaactgagtatttgctgactgaatgaccaacacatgcagcccatccttataagctgagcgtcttgtgcaccctccactttggatgacagcctccatgcaggaaagcacacatacaacatcagaagcatgctgtgtttggcattttcctgctgcaggcgcctagatacatggatgtcagtcacagtctcccactcaatcaagcagatgtctacataattaactgcaggtaggcaaagaataccacctacttctaggatacccctgcaggcatgaatatcttggaaagtttgtctaagcatcatgtttattgaaatagactctaccagccaggcacagtggctcacgcctgtaatcccagaactttccagctacttaggaggctgaggcaggagaattgcttgaaccccggaggtggaggttgcagtgagctgagaatgcaccactgcactctggcctgggcaacagagtgagactccgtctcaaaaaaaaacaaaaaacaaaaaacaaaaaaaaccccacaaagaaatatactctacctattaaggatcactgaggtatgcccacatgtcaggtttctctcagatgtggtaagtctgggagtggaggaaacaactggtgtctgaatatgactaaaacgtccagtggacaatgcagaaataagagaggcattcttgacacagttgcggtaggttgaagatgccaaaatattcaggggccgtaggattcctg

SEQ ID NO: 9299 - DNA, 3047 bp, Homo sapiens
gctggatttcatgtacaagtataaagcacctcgaaggatggaattgcccctggaggtacacagtgtctggggctgtgggttggagtgtgtttgtccaaaggctatgccctggagattgggggtcctgggagcagcatctcttggggcaccaacatctcctcaatacctggggtggaaagatctccttccatcaaacaagcagaaccagtcactggatagcatccagctacttgccaaggagaggaaatcctattaatttcatttagaaataggagcgtgagccgggtgcagtggcttatgcctgtaatcccagcactttgggaggccgaggcaggtggatcacctgaggtcaggagttcgagaccagcctggccaacatggcaaaaccccttatctactgaaaatacaaaaattagccgggtgtagtggcgcgcacctgtagtcccagctgcttgggaaactgaggcaggagactcgcttgaacccaggaggaggaggttgcagtgagactgcactgctgcactccagccgggatgacacagcgagactccttctcaaaaaaaaaaaaaaaaagaaaagaaaaacaaataggagagtggtaaagtatctaggtctttattgttttgttttggtttttccaggtattaacaactaccactctaagttgacgtacaagtgaaaaacaacccaaattgactgttttgggggaagaaaactcagaatgtgttatttgaaaagtttttataaataagaacaaggcttgttcatcgctgtatctccaagacacagcatatagtgcctggtataaagtagctattcatgaaatgttagtgaaggggtatagccctttagggttaccaaaaccaatacccttgacatatatgctattttcagttgtaggatgtggatggagttctggcagcaggagggctgagcctggagcctcctgggccttgctctgtgatgtgggtagggagtcaccagtcatgagcacaggtgcagggaccccagtctttctctctgcttcctaaggtctcctctcctattccccatctgctgagtatcacggcctgagaggccatctgaagcaaataggaagtctccgtacagacccttgtgagacttatatggggagatgccttgaaatgttcccttctgcagacactgagcagcctagcattcttatttgttaggactgtaattatgaccacctccatgtgcagttcatcaggttcctttgcaaggtgaggcacacatgcatcccttttaaagttagagggtttgggaaaggatgttctgggcttggacactgctggaggagtctggcctgggcaatctggcctgggcagcctcctgatggggagaggagcccagcctaaagaattctaaggcccaagggtttgtgctgttttgcttttgtttattaaagctgcacaaactgctttactgtttacagttcaccagcctgccaagaggcagattactataaaggtgggttccgttgtttccgttttcagtgtctgtccagaggtggctggtaagcatttcctagtggtaaggctgtagcatgaggactctatgagagggcctgagtcttgttttctggctcattcacttcctgccttgtatgtgcctgcccagcactgagccacttaccaggaaatggtggtgaatgcgacatgggcctgccctcaggaagtccccagtctggtggggagagagtgagcagggcccccacacactcccttcccactgggtgcaaagtcctctgctgggggacatgtacaaaacatgagagaacaaaggaggtgacgatgcctggttgtgcatggctgggcagtggcaggaggggctccgggaaacctttgcagaagtgacttttgagctgggtcctcaagaggcctagaaatatgcaagacagaggagggagggaagggcttccagtcagaaggaatagaggcatgaatgggcacagtgtagagaaagaagttctctgtgtatacagagaagtggacagacacgggggccaagggtaggttggggccagttgtgtgaaccccctcaagtgctgtgccagaaaatgttcccttcactttcattgaaataggaactcctcctgtgatctgtgtatcccatggaaggaggggtctcttgagagtcatttgtgggagagatgaggtggagcccttcatataagttgagcatccctaatcgaaaaatctgaaattctttgagtgtggacaagacgcacaaaggtcatgctcataggagcattttgaatctcagattttcagattggggtgctcaattggaatgtatatgcaaacatcccaaaatctgaaaaaaaaaaaaaaaaaatctgaaatcccaaacacttctgactccaggcatttccggataagggatattcaacctgtacttcaaggtggtgtttgcctttgtggtgtggtgtgctgtacattaagaggtttctcatccagaaaggggactggaaatttgatgatggaaatttgaggcatgtaccaaaacacattaggctggttcccaaaggaaataacaaaagcaaaggaagcatgcggaggtgtctctttctgctgaatcatttaagataattttgctcctcaggcagaaacaagaaagatgtgtcattctgcacaaccgttcccttgggagattgaggagcataatttaagagggaggcatcagcctctcaaagggctcagcttcatgcgatatgtgggatgggactctgatgattgcttcctgttgcggagattcagggagaccccagccctagccagctgcatttggccaaaggagctggaagtctcaacacaatgccttccaggtgctgacctcaaaagatcccacatttacaccaaactgagggacacctttctgttttctctaccaggcaccgcctagaatccttcgatctcgcttcaggaagaaaagtacctcatcctcggccaccgaaaccacgtgagtgagatgagccaacagcaccggatccacagaatgtttcttctctgccttaaagagctatt

SEQ ID NO: 9300 - DNA, 6455 bp, Homo sapiens
cggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctggtgtgtcccttggtggagagggcgctgccggccctgcgcggtttccagccaggaagcttcgggaagcctggtgagagctgagtgcgcgaattcggatcttagagaaaggcaccccgttcacccacgacccttccgctcctgccgctgcttccctgagtcgctcaggctgtgggaagatgtttgtcggcatctttgaaaaattgatttcttatgctgcgtcaggtggtttccttgtcactgtggctgctcagcgggaggctgttctggcgggaggaggactgctcggttgtctggtgggcattccgcctcgtggtcctggtcccttgatacctgcaggggatcagcagcccgcgtttcgtggccactgtgttgtaactccaacttcccctcccgcaaattaagcgtagagtaaggggagagagtaacatgggtcggatttttctagaacggcccttgtgacagtgagctttttggtggcagggagcttctttggtccgccttcctggagaccagatgcagcaaaacgcagtctttttcttttcgagacagagtctcagttgcccaggctggagtgcagtggcgcgatctcagctcactaccacctctgcctcctgggttcaagcgactttcctgcttcagcctccagagtagctgggattacaggcgccagccactaggccagctaactttttttttttttttttttagagagacgggtttcaccgtgttggccaggctggttttgaactcctgacctcaagtgatctgcccgcctcggcctcccaaaaaacgcagtgtttatgtgatgctcctctgtggtgtttgcaagatttatacaaaattgcggtttctttttttctctaggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttccttcgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtcaggtgaggtacgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtcagactcctgctaagagacagtatcaagaaagataacttcaaaatacactttctggaggcctggcgcggtggctcaggcctgtaatcccagcactctgggaggccaatgcatgtggatcacctgaggtcaggagttcgagaccagcctggccaactgcctgaaaccccatctctactaaaaatacaaaaattagccaggtgtggtggcgcaagcctgtaatcccagctatttgggaggctgaggcaggagaatcgcttgaacccgggaggcagaggttgcagtgagccgagatcgcaccactgcactccagcctggacaacagagtgggactctgtctcaaaaaaaaaaaaaaaaaaaaaagtacagtttcgggatttcataaattgggttccctgagggtcatttggtgaatccgggttaaagaaccctggtctgcatcactgtccttgtttgtttttcagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactggaacacctttttcttggtctgttgtgcacagcccaggtttggggggtactggtcattgactgtttcagaagccgctgtgtttggggaactgccctggcggcttcagaggtgtgtgtgggttgaagggcaggcagctctgcaatagacctcaccttggactaacacctgagggctgcctcgccaggaaggattcaggggctcaaccccagcctgagtgcctgggctgggtggatccacagcggggcgaagggtcccacacacagcatcgatgggggctcagggtgctcagccctgggcattacataaaagctgtttattgacattacgttcttcagagtaacaaacccccttggaggactctcctgccgggatgtccatgtccgcctttgctccgagctggggtctcatgtctgtggtgctggaatccagagccctgacggtaggggagtgattttgcaacacagttgcatttcacatcttctgacaggattccttgagggagggttggaccctggcacctggccagctccaggaagggtggccaggcccctcactgccccatcaagagtacttggtgttggagatcttcttccagagcagagtcttgaggtggctgagcaccagcgagtgatgggcctccacctggctggccagcccgctcagcgtggtacaggtgcgcagctgtgtgcccagctcctcgcggaggtcggcgggcgcgccaggcagcaggtagccccgtagcagtgcgcacaccttggccaggttgggctggatgaggtcgcccttgcactgcctcatgagcctgtcacacggggccctgcagtcgcgcccgtaggtgcagtcggtgctgtgctcgcagcggcggccctgcaggaagcggcgcacggtggcctcgggtgccacctgctgcaggtcggccatcttgaagtcgtaggtggctgtgtagcccacgttggccagtgtggtctcacacatgtagaaagtcccgtaagagccgtggaagagctcctccacgaactccagcaggccgatggcgatcttggcccgccaaggccacgcaggccccagccactgctggagagcaccctgcagggcaggcggcagcagtgggcgcaacaggggtggaagggcggccgcgtgccaggcgccatgcggcacgccctcggtgaggtagaggtccccacagtagcccagcagtctggaggcgtgctccttctcctgcagggacagcagcagcaggaactcgttacgctgcagcagggcccacacggacttggcttccgccagggacacccggttgtccttgttgaagtcagccatgagcaggacctggccaaccagcgccggcagggaaggcaggtctcccaggttcgcctggcgtttgggaccaaaagaaaggaaaagccagctgatttgatgtctgggagcacgacctggcctttacctggtcctcctggcggggtggtctgccggccagaccagcacatctgccaggttaggggtcccagcccacagctacacgggtggaggacgcagccagcaatgtgtcagctcactctgctggcctgtgtggctgctgccagacagacctcccgcctcctggcagccttgggtgcacctggggagctcgggggtgggcacctgggcagagaagcctcagagcttccctgaggatgagaatcggcacagggcagagggcacgcactggctgaagccctgggaagcggcccctttccacaagccctggtctccattcggggcacctgccctgctggacacacggcccttgactgcaggagcctcccctcgacctcagctgccagcccaccggcgcccccaacccttgcccccagccctggagaggctccttccctggcagggctcatgcccaggggctgggggatgggaggtctgcccagggtccacttgggcccatctgtgcctttgcgctgggcatgttggtgccagggccgcctgctgggcatatgaccgtggtgtggactcctgccctgccccctaggagagctgcctgaccttgaggaagctgagggtcatctcccggaattccttgatggaggtgccccgggtgggcttgtcaaacagtaccagctcccgccggggggccgcatccgaccgggccttggagtcgagggtctcctcaatgccacacttgatggttacatccttgtcccgccagagcccgctgtacacctggacagggccacagaggtcctccgtgcagacatccccctcccactgcacgggcagtatcagccccaggcccacccgccctgccagtggctatacctgctggcccggggccaccgagaggcaggtcctccactccaccatatgcagctcacacaggtcctggcagacggagcccgagatgatccccttgcggtactggtcacactgaggagacaggtgcaggcgtgccgggcggggcagccacacccctgccccactgagcccctgcccacaggcccgaagctggcaggggcctccacttgctgcagttggaaagctgccagcccctcacacaggcagtgccggggccctgggtcatgccattggtggctgcaggatggggctgtcggctgcaggggcagccccgc

SEQ ID NO: 9301 - DNA, 14471 bp, Homo sapiens; identical to SEQ ID NO: 8771

SEQ ID NO: 9302 - DNA, 122 bp, Homo sapiens; identical to SEQ ID NO: 8772

SEQ ID NO: 9303 - DNA, 2688 bp, Homo sapiens
gatcccctttctctatgtcgggacactcattagcaagaactttgctgctctacttgaggaacatgacatttttgttccagaggatgatgatgatgatgactaacaggtaagacttgctttaccctagatggagcaggaagcagggtggagcatctgtctgtgatgcagtctggcctggtagcagcatttggacactgggggcagaagcattaatgaattggcccacttggtggctaatgttttcgtttgtttgttttttgagacggagtttcgctcttgttgcccaggctggagtgcaatggcatgatctcgactcactgcaacctctgccttccaggttcaagcgattctcctgcctcagcctaccgggtagctgggattacagacatgcgccactgtgcctggctaattttgtatttttagtagagacggggtttctccatgttagccaggctagtctcaaactcccgacctcaggtgatccacccaccttggcctcccaaagtgctgtgattacaggcgtgagccactgcgcccagccaacttcatgtgctctaatatgtgctgcatggcattctgtcaagagatgaggacactcctgttccttagcctggcattcaaggcttgccataatctggtcacacctcttattccagtctcatcttccatatttccagccacacaccgattcccagtattcaccatttcttgagttttcacactcatacccacccccaaacattggctcattgttcctcccacatggaaggctccttcccagagctctgggtcttaattccacccattctacagtgtctttgaagtcttcgttcctcctttcatttgaaagttgacggctccttcctctaagcaaccagtacctctcttcaaatactcggtattatgtggctaaacacacacaaagcaaaattttactagactctgagcttcttgctggcaggggacgttttttatacattgcggcccccagtgcctggcctgtggtgaatgcccagttaacgtgcgcatgaacaaccaaacgtgctcaaagctgcctttctcctgccatgtttgatagaagcactttgtggaattctttcagtctgcggatggaagactacgctgttgcccagttcactgctgctttcctttcttacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattctgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacggacctaagtgttcctctgagttctgcaagctgctccagcaaattaaaaagaaggggtcagccaggtgcggtggctcacacctgtaaccccagcactttgggaggccaaggcgggcagatcacaaggtcaggagagcgagaccatcctggctaacacagtgaaactctgtctctattaaaaaatagaagaaattagccgggtgtggtggcgggcacctgtagtcccagctactcgggaggctgaggcaggagaagaatggcgtgaacccgcgaggcagagcttgcagtgagccgagatggcaccactgcactccagcctgggcgacagagtgagactccatctcaaaaaaaaaaaaaaaaaaagaa

SEQ ID NO: 9304 - DNA, 35 bp, Homo sapiens
ggtgacagagtgacactccatctcaaaaaaaaaaa

SEQ ID NO: 9305 - DNA, 98 bp, Homo sapiens; identical to SEQ ID NO: 7600

SEQ ID NO: 9306 - DNA, 101 bp, Homo sapiens; identical to SEQ ID NO: 6685

SEQ ID NO: 9307 - DNA, 193 bp, Homo sapiens; identical to SEQ ID NO: 7396

SEQ ID NO: 9308 - DNA, 153 bp, Homo sapiens; identical to SEQ ID NO: 6795

SEQ ID NO: 9309 - DNA, 193 bp, Homo sapiens; identical to SEQ ID NO: 7690

SEQ ID NO: 9310 - DNA, 136 bp, Homo sapiens; identical to SEQ ID NO: 6219

SEQ ID NO: 9311 - DNA, 359 bp, Homo sapiens
gctgatgcctgtagtcccaacactttgggaggcggaggcaggaggatcacttgagcccaggagttcaagactggcctgggcgcggtggctcacgccagcactttgggaggccacggcgggtggattacttgaggtcaagagtttgagaccagcctggccaacatggtgaaactccgtcttttctaaaaatataaaactagctggatgtggtggtccatgcctgtaatcccagctacttgggaggctgaggcagggagaattacttgaaccaggaggtggaaggtgcagtgagccaagatcacaccagtgcactccagcctgggcaacaacagcgagactccatctcaaaaaaaagaaaa

SEQ ID NO: 9312 - DNA, 131 bp, Homo sapiens
ttttttttttgagacggagtctcgctctgtcgcccaggctggagtgcagtggtgcgatctcggctcactgcaagctccgcctcccgggttcacgccattctcctgtctcagcctcccgagtagctgggact

SEQ ID NO: 9313 - DNA, 4802 bp, Homo sapiens; identical to SEQ ID NO: 7769

SEQ ID NO: 9314 - DNA, 3093 bp, Homo sapiens
tccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtgaacacatttgggaaattcttctgatcctaccgctactctcttgaggtacagtaaattgtctttgacttccatcaccttttgtaatattacaattgccatctactgagttcctatgatctgcctggcattgtactaagtgctttatattttcttgttcatttttttatgccaacataaatgagtttgactcaattcttattataacctgccaaaataagtattcctcttcctttttacagagagagaaacaagggaaaaaaaagttaattgcctgaggatatactgctagtgttgcgggacaaatagagacgggagaggccaaacagaattcaggacaaccctttattattaaggtgatcactggctcagtcggactggggtccagaaagtctgagcccggaacaaagggatcaatcaccttttaagcaatttgtggcgggagtttggtgctacaggaagcctacttgcagaagcaagaacaaaggcagttaattattcttttacatttgttacaccacatgtcttacatccttgggaatgcatgcttttgtagcaattgcttatcaaccttgtgactttacagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataaaaaaaaaaatcc

SEQ ID NO: 9315 - DNA, 3186 bp, Homo sapiens
tccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctgattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtgaacacatttgggaaattcttctgatcctaccgctactctcttgaggtacagtaaattgtctttgacttccatcaccttttgtaatattacaattgccatctactgagttcctatgatctgcctggcattgtactaagtgctttatattttcttgttcatttttttatgccaacataaatgagtttgactcaattcttattataacctgccaaaataagtattcctcttcctttttacagagagagaaacaagggaaaaaaaagttaattgcctgaggatatactgctagtgttgcgggacaaatagagacgggagaggccaaacagaattcaggacaaccctttattattacggtgatcactggctcagtcggactggggtccagaaagtctgagcccggaacacagggatcatcaccttttaagcaatttgtggcgggagtatggtgctacaggaagcctacttgcagaagcaagaacaaaggcagttaattattcttttacatttgttacaccacatgtcttacatccttgggaatgcatgcttttgtagcaattgcttatcaaccttgtgactttacagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatgtgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 9316 - DNA, 3186 bp, Homo sapiens
tccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtgaacacatttgggaaattcttctgatcctaccgctactctcttgaggtacagtaaattgtctttgacttccatcaccttttgtaatattacaattgccatctactgagttcctatgatctgcctggcattgtactaagtgctttatattttcttgttcatttttttatgccaacataaatgagtttgactcaattcttattataacctgccaaaataagtattcctcttcctttttacagagagagaaacaagggaaaaaaaagttaattgcctgaggatatactgctagtgttgcgggacaaatagagacgggagaggccaaacagaattcaggacaaccctttattattaaggtgatcactggctcagtcggactggggtccagaaagtctgagcccggaacaaagggatcaatcaccttttaagcaatttgtggcgggagtttggtgctacaggaagcctacttgcagaagcaagaacaaaggcagttaattattcttttacatttgttacaccacatgtcttacatccttgggaatacatgcttttgtagcaattgcttatcaaccttgtgactttacagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 9317 - DNA, 840 bp, Homo sapiens
gagttgagtccaggcccctgatgctgcggcggtcttcacttgctctcacccacgagccactgcagcggcagcggccctcttctccgtcgtcactaggacggggcccaaggtcctctcttgctctctcccagaagctgcagcggaaaccttcgtcttcactttctctctcccaaaagccactgaagcggtagctggcgtcttcactgccgctcacaccagaggagtcgctggctgcgtagccgcggtctccacttacttcctcccaagaactaccaacgctgtggccgccttcgacactccctccctcccaggagccactgaagcggcgactgcgatcgtcactgactctatccccgaagtcactagttcgcgggtcccgaatgtcactgactccctcccaaggaccactgaggcggaggcctcggtcttctctggctgttcccctggagtcggtagtttggtggcctccaacttcactaaaattcacgtcgctgctgcagaaggtgctgtctcccctaactctctcccaagagcagctgtgactgtggccactatctcccctaactctctccctagagacgctgcggcagtggccgaggttttcactgacccttctcaagtcactgcgggagaagccggcgtctgcacttaggcttcctgcagcgaccctggagcggcggtcgctctcttcacattttctttccccgtcgtcgctaactctttccctagactcggcgccggaatggccgtgtagaccgtttatcctccacacgtggtggctagtgcggcggccaccgtcttcgtctgctactccctgcgaatcgccgtagcggcggccgc

SEQ ID NO: 9318 - DNA, 108 bp, Homo sapiens
ctcacaccagttagaatgacaatcattaaaaagtcagggaacaacagatgctggagaggatgtggagaaataggaactcttttacactgttggtgggaatgtaaatta

SEQ ID NO: 9319 - DNA, 840 bp, Homo sapiens; identical to SEQ ID NO: 9317

SEQ ID NO: 9320 - DNA, 1663 bp, Homo sapiens
attacctttccatctactctaatagcatttttcaaatgccattcctcctcttcttcatcccagtattgttcaaattgttcttgacagatttcacaactctaaaatagaatcatataaaatgaaatttacataatagaccatatttaaccccattaagtaaaaatatacaaacactgttaagtggagtaaagaatttatgagtgttccaaaagtttgaataatgtccaatatacagtatgattcaaaatacatttatgggattctgtcaatctttccagtaaaaagagtaaacatttcactgcttttggccactgtagttatgaaactcaaagctagattgtaagagtaaaattgaagagtagagctttcaagaagtcttaaaatcattaaaacagggatataaatatagtgatgtgtttatgagtatttacataaaggaagtgagggacactcccactgtgagaaaacttaaacgttcttctctcacctcaactgctccagctggtccagcaggtacactttggaactctttttctttagcagcctcttgagttttgagcacaacttcttcatgcaccttttcaaaaaactggctctttgcccgttcttccagatcagctatctcctcaaattctatccagtccttaaaaggagttgatttttaaaagattattccatttatttctaaatttttactgtgtatcttcaatataatgccatttaaaggtaggggtatactattttctacattatgctctaatattatttaaaattatactttgaaacatataactaatgacaacatgaaactaataattaagatcttttccattaactctatagttacaactactaattcaaaaaagacaagcttcaagtatatttttttttttacaaaaaacagtcctagagcctgggaattttagagctagaacaagcctgtaggctacactctaatcttaattaaaaaaaaaaaaatttcccttcaaaattcattttttaaaaaatgtgtttatattccaggggtcaaagcctgggacttttagagctagaacaagcctgtatgctatactctaatcttaatttaaaaaaaaaaatactcttcaaaattcattttttaaaaaatctgtttatattctaggggtcaaattttattcaggaaatttcaatgttagattccagcagttattaaaattattaaattacttaattaaaattaaattttaataattattaaaattaatatacttttagaatgatataatttaagcctaaaagatactatggaggcacatgggttacttactgttaaactgtagtaccaacgtctatgagtgacttttcggctaacatccttttcagttctattttgccgataatgccagtccaaatgatctgcataaacatctgtctgtgatgttgtaaacctcattccacaagagtaacactgaataccagtgtacagtcgatttataacactgtcataacgtctattttgaaaaagaaataatctttagtgttgataatatggcttaatggcctttaaaagccaattacaaatatttcaattttccatactgtaacaatggtgaaaccaagagctggctgaaacagttaatacccaaagatcagtattattctctaacaatgtgattgaccctct

SEQ ID NO: 9321 - DNA, 1265 bp, Homo sapiens
ttttttttttgagacagagtctcgctgtgtcacccaggctggagtgcagtggcgcaatcttggcttactgcaagctgcctcctgggttcactccattctcctgcctcagcctctccgagtagctgggactacgggcgcccaccaccacgtccagctaatttttttatttttagtagagacggggtttcaccgtggtctcgatctcctgaccttgtgatccgcccgcctcgtcttcccaaagtgctgggattacaagcgtgagccaccgcgcccagcctggaagaagtttcttaagtgaaacagggttcagaatacatcctggagtggtcatctcagtattctagagaactggaaccttttgtgagtaggaaggaaggtatgattccagttagtaaatatgactagtcctccacttctacctcagtttttctaaagtggggtgataaagcaggatatcataaatcagctttttatatcttgtttcagagaagggagcagggccaaccccaggcaaaaacaaaaaacgaagtggatattggtgacagtctgtactcctttctgcctatgtgccattttctgttatttcccagtcattcttgttcttcttttggtgctcactcccaaatcttcacaggggtactccttgggtaccttttggctcttatttagctactcttccccacctgctcaacacaatgcccattatctctgggagctgaccccatttaggattaggaaaaaacttcccaattctacaagagtgcaggtctttcttgataatagtctttattttccatttctacctccatttaggcagctacatttttccacctgcagcatggttagatgcctcctcagattttcctgaatattttgtgtaaacctccattaggttgcttacttggtactaaattgtaaggtcagtcatataaaaaatatgtatatactaagctgttatatgagaatgttttaattttttatatgtaattccttatttttcttcccaaagctttttatttttagctgaattgcaatgagattgctttctattttccaaagcatcaaagttggacattttcagtgggaaaattacactaaaaccaggaggatataaacttaatgaaatctttagattttaggaaacacatacttttccttttacttgttctctcaaacttcaatttaaaagaaaatgttccatcatctctgaggcttcatttaattttccttactgcactttacagtgttagattactacttctagc

SEQ ID NO: 9322 - DNA, 840 bp, Homo sapiens; identical to SEQ ID NO: 9317

SEQ ID NO: 9323 - DNA, 603 bp, Homo sapiens
gtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccagtggttctgcgctcagggcatgaccggagatgtggtctgggagttggttgtgtggatgtttgcgttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtgagctgtgatcacaccctctagcctaggcagcagagcgagaccttgttctaagaaataaaaagagaaaaagaaaa

SEQ ID NO: 9324 - DNA, 921 bp, Homo sapiens
ggacagctggcctctgtgcagtgggtggcgggggggtgctggacggctggcctctatgtagtcggggaggctggatgactggcctctgtgcagtgggggcaggcgctggatgactggcctctatgcagtgggtcggggggcctggacagctggcctctgtgcggtgggttgggggggcctggacgtctggcttctgtgcggtgcgggggccggcctcgggccggtgggcaggctggaaggtcagccaggccctgtggtgtctttagtgagaaacaggaaataaatcaaggggatgttgtagaagttttaccgctgctggtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccagtggttctgcgctcagggcatgaccggagatgtggtctgggagttggttgtgtggatgtttgcgttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtgagctgtgatcacaccctctagcctaggcagcagagcgagaccttgttctaagaaataaaaagagaaaaagaaaa

SEQ ID NO: 9325 - DNA, 586 bp, Homo sapiens
atgtttgtttttttaatgtgttgttgttttctttaaaatcaagaccagttgttacaaagaagtaacatgttttaatgtcattgtcgtttaaaaaatatttttacttcttaaagtagactagccaaaaggtcccgaacttggtatctaaaatgaatatggggaataaggattttgaaaaatagctgttgctctcattctttttttttttttttcaatatgagacagggtcttgctgtgtcacccaggttggattgcagtggtgtgatcatggcttactgcagcctcaacctcccaggactcaagcaatcctcacagctcagcctcctgagtagctgggactatagatctgcatcaccacatctggcaaattttttgtattttttgttgagacaggatctcactttgttgtccaggctggtcttgaactcctgggctcaagcgatcctgtcaccttcgcctcccaaagtgctgagattacaggtgtcagccatagcagccggcctattctctcattcttgaagaatgaaagctccatgttatgtttgaagttttacgagttgactgctttgtaagaaaaaaaaaaaaa

SEQ ID NO: 9326 - DNA, 597 bp, Homo sapiens
aatacttttaaatgtttgtttttttaatgtgttgttgttttctttaaaatcaagaccagttgttacaaagaagtaacatgttttaatgtcattgtcgtttaaaaaatatttttacttcttaaagtagactagccaaaaggtcccgaacttggtatctaaaatgaatatggggaataaggattttgaaaaatagctgttgctctcattctttttttttttttttcaatatgagacagggtcttgctgtgtcacccaggttggattgcagtggtgtgatcatggcttactgcagcctcaacctcccaggactcaagcaatcctcacagctcagcctcctgagtagctgggactatagatctgcatcaccacatctggcaaattttttgtattttttgttgagacaggatctcactttgttgtccaggctggtcttgaactcctgggctcaagcgatcctgtcaccttcgcctcccaaagtgctgagattacaggtgtcagccatagcagccggcctattctctcattcttgaagaatgaaagctccatgttatgtttgaagttttacgagttgactgctttgtaagaaaaaaaaaaaaa

SEQ ID NO: 9327 - DNA, 280 bp, Homo sapiens
attttcatatttagatttatttttaacatagattttatttattttttatttttttggagacaggatcttgttctctcgcccaggctggagtgcagtggtgcaatatcggctcactgcagcctccatctcctaggttcaagtgattttcctgcctccacctcccaagtatctgggattacaggcacatggcaccacgcccggctaatttttgtattttttagtagagatgaggtttcaccatgttggccaggctggtcttaaactcctgacctcaggtaat

SEQ ID NO: 9328 - DNA, 8025 bp, Homo sapiens
ttgttttctgtccatctttattgttattgctggatattaaatgctgtaatttttggcataggttttttccaaagactggtctcttgggtcaagttttcctgaacttgcctggtattgggcaagttcacacagaaaatatgagtcatttcacaaagtcctgggcttgtctatctacttgaaggaataggaaatggacttcacttggagcatgatggatgaggcttgggcttttactaatgaaataagtttcaatcttaactcagttaaacctttaaagacaggagaaaactatctggggatggattcaggccagtgagatcacgttgcacaaatctccccttaagggatctttactgacctagaattgtttcaaaataagattccaaactgtcgagggagtttgaagccttgaaacttggtgtaggtttgcttaaaacaaaataacgaatatactacatttcccaggaggcttcgcggtgagcctccgcactcggctggttctctttaccgcgaggaaagctgggaaatgtagtgccacaggcaaccctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgaaccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggaggtgagacgtctcgggggtggggagggggagggggaggaggaggccccgaccgcggactcgagctggggacccaagtggggtggggatttgctgtcggttgttgggtccttcttcgggtcaggaagtactgtctgggaacctagatggtgtaattgccgggtgtttggtttacacgcctctcttgagtttcccgttagattttcccaaactgagcccactgccaggagaaaggtaagagcaaaggcgtgaagatgagaaatagggaagggaggatgaggatgagcaattgctgtttatggcaggcgtactgtgaacttaagtctccagcctttcagctgtccggcaaatctctccaatcagcagaagcagctgagatcctctgtggggcctcctggttaggtgccggctggggctgtagtcctgcccctctgttgagggaggaaccgcaaggtgtttaacctggcttcagtgggagaacgcaggaagcggaactggtctgaaggactgtagctttgttgtggggctgtgggtgggagggaagacacaaaatccccgaacgagccccttggctacgcagtcagatgcccatgagggctgatgagctgtgtttttgtccgttgattgcttaaataaaggtaaccaaggaattcttccaagaatgtgaaatataccacttctctgacctatcttcccaccacttttttcctcaaactggagaaggtagggaggaaggggacaccgagttcattcatttctttcccgggtgtggcctttggactcaactattttttcagaggcagaaatgccttattgttaattagaaggtatttagctaggaagagctggtgatgggggagagtaacttaaaattttatttctctctgttaaaagaacttgtttcaaggggggaaaactcgtaccaatggaaaaattgaaaatgtgtgctcctgttcatatggaagtttaaaaagaaattaacaaacatttacattgcaattaaaacattctccttaagaacccccagtagggcccagtaccgtggttcatacttgcaatcccagcactttaggaggctgaggcgggaggattgcttgagcccaggagttcgagaccagccatgggaaacatggcaagacccccacctctacaaaaattaaagaagaaagtagccgtggtcccagctactcgggaaactgagacgagaggattgcttgaactggggaggtcgaggcttcagtgagccccgttcgcaccactcactgcactgtagcctgggcaacagagtgagaccctgtctcaaaaacaaaggaacaaaaaatttaagtctggcaaaattaaaggttcaaagtttcagacactctatcctgaccgctctgccctcccactcctaaataatataagggtccctatttcacggatttgggttaaaagtggcctgctattaatagttaatttttaacaattgctgtagttttcctttagcaaagaatataattggctaattttttttcagtgtttagtctaaatttcccttagctttgattcctgtcacagatgtgaaagataatatttccaaacctcagaaattactctgtttctctccttagccaaaaggctttccccatggaatacttactcagccttaaggagtctcagcacctgcagacttggtggtagattccagcaggactcttcagcaacatccacacagtgtcttcttcttgggactcctctgggaccttttccatttattccattcttgcccaagataatacctgcaaccttatggtggatgtagagttccccagggtgtgttcttttcataatacaatttgattagaaaccaacagtgaaattgaatgtggaagatacgaaagcaaccacacttgtctcatttcccccttctcccccatcaccccttccctgagaaaaccccctaaatctcccagaaactatttaacctgagaatgagaattgttttcatagttactcccacccccagtcttggagacaaacagtagcaaataaatgagcttgacagtagagtaaaagctggaaacccctttggagagtgagtatgaatcatccatctcacactaaatacacgcatgtggactcatctcagtgaattgagggcttaaagataaacatatgggattggagttgtgtgtccatagggtttcactgcctatttgatttgagtttatccctattaattttttacagtgaaattttattaaagtataatgtacatatattttcagtggattttgctctgaaggttctccagtggtctgactacgagatagtgcggcttcagctgtgggatattgcaggtaaagtgggagggctagataggaacaagggaagaaattttgatttaactagaaagctctgaggaaaaaatggggcagcaaagccagaaattgtttttctgaagctggaatgattgagctgctctgaggacacatgagctgaataggtgcagagcttttgtagatgttttgccctgaatagatctggagcagtctctgtgtggatggaggggctggcaaggtggtggattgtccagactataggtggacactcccacagcaggggagggtgctttttctaggtttaaggctgaccttggtgaaaaacaagatccccagaaaatagatacagtaaaaatagtgaatccttactatgtgccaagcattcttctaagtattttaaattcactgactcattaatcctcacatcaaccctatcataaaagctactgcttttggagaattgcttgaacctgggaggtggaggttgcagtgagcctagatggcaccactgcactccagcctgggcaacaggagtgcaggaaactgtttcaaaaaaaaaaaaaaaagcgactgcttttatcttcactttacaaatgagaaatctgaagcactgagagcttgatttgcccgaagtcaaatagtatgcagcagagcagggatttggactggagcaatctgggtgcggaatctgccttggaaataattgggcttcattatccctttatgggatagaaaaccaagagtcagagggggaaagtgagtggccccatctgacacatatgcttactgccctcttctacaaggaatggggagaggccggctcttgggtcaccttgagaactctcccctttctccccagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaaggtatgtggccaatctcagaaaatggtccctagcctctatctgtggttagaaaggaagtaaaatgctctctgattctgggcatccatttccccttcttaagttggcaaaatcatctctacctccttcaaaggatgttgagggtgagtgagactttctttcttttttttttttttgagacggagtctcgctctgttgcccaggctggagtgcagtggcgcgatctcggctcactgccagctctgcctcccaggttcacgccattctcttgcctcagcctcccgagtagctgggactacaggtgcccaccaccacacccagctaatttttttgtatttttagtagagactgggtttcattgtgttagccaggatggtctcgctctcctgacctcatgatctgcccgcctcagcctcccaaagtgctgggattacaggcgtgagccactgcgcccagccaagggtgagactttctttgggaagaatgttgattatagatttccgatgctggtgttcttatccattggtggaaatatgtttaaaatccacagtatctgagccatattctttcttagttgcaggaagtttatgatactgccttttattttttctctttgctagtgtgatctgtccccttgggcagtgagccgggaccagattgaccggttcagtaaagagaacggtttcacaggttggacagaaacatcagtcaaggagaacaaaaatattaatgaggctatgaggtaagtagctcatgctgataggcatgcagatgtatccatcttccactgtggccctgtggaccctcttttcttatttctgagccaacaatgacagactgagccattggaatgctagcccctaaaggtcagggatactgtctttcctgagataactggggacaaaggggcatttaaaccttctggctttaccaaatactctctgatgataagtcagactacatctgccatttctgcttttcctccaaaataagcttctcaggcttattttttgtcttttagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacatgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaaacaaaaagaaaaagatttttgggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 9329 - DNA, 7307 bp, Homo sapiens
  misc_feature (7)..(7): n equals a,t,g, or c
  misc_feature (154)..(154): n equals a,t,g, or c
  misc_feature (843)..(843): n equals a,t,g, or c
gaatagnaaatggcttcacttggagcatgatggataaggcttgggcttttactaatgaaataagtttcaatcttaactcagttaaaccttaaagacaggagaaaactatctggggatggattcaggccagtgagatcacgttgcacaaatctcnccttaagggatctttactgacctagaattgtttcaaaataagattccaaactgtcgagggagtttgaagccttgaaacttggtgtaggtttgcttaaaacaaaataacgaatatactacatttcccaggaggcttcgcggtgagcctccgcactcggctggttctctttaccgcgaggaaagctgggaaatgtagtgccacaggcaaccctgcacgtgacgcttgcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagatcagaccacacaggcggtgggtgggaatgcctcctttcagtttgaagagggtccggatccaaaggggttaaaacgagcgacccccgatcccgatccacacttancgcctccctataacgcacaccccgctagccatgggcagccgcgactcacctgttcaaagtgctggtggtggggcacgccgcagtgggcaagacgtcgctggtgcagcgatattcccaggacagcttcagcaaacactacaagtccacggtgggaggtgagacgtctctggggtgggtaggggtagggggaggaggaggccccgaccgcggactcgagctggggacccaagtggggtggggatttgctgtcggttgttgggtccttcttcgggtcaggaagtactgtctgggaacctagatggtgtaattgccgggtgtttggtttacacgcctctcttgagtttcccgttagattttcccaaactgagcccactgccaggagaaaggtaagagcaaaggcgtgaagatgagaaatagggaagggaggatgaggatgagcaattgctgtttattgcaggcgtactgtgaacttaagtctccagcctttcagctgtccggcaaatctctccaatcagcagaagcagctgagatcctctgtggggcctcctggttaggtgccggctggggctgtagtcctgcccctctgttgagggaggaaccgcaaggtgtttaacctggcttcagtgggagaacgcaggaagcggaactggtctgaaggactgtagctttgttgtggggctgtgggtgggatggaagacacaaaatccccgaacgagccccttggctacgcagtcagatgcccatgagggctgatgagctgtgtttttgtccgttgattgcttaaataaaggtaaccaaggaattcttccaagaatgtgaaatataccacttctctgacctatcttcccaccacttttttcctcaaactggacaaggtagggaggaaggggacaccgagttcattcatttctttcccgggtgtggcctttggactcaactattttttcagaggcagaaatgccttattgttaattagaaggtatttagctaggaagagctggtgatgggggagagtaacttaaatttctatttctctctgttaaaagaccttgtttcaagggggaacacctcgtaccaatgctaaaattgaaaaatgtgtgctcctgttcatatggaagtttagaaagaaattaacaaacatttacattgcaattaaaacattctccttaagaacccccagtagggcccagtaccgtggttcatacttgcaatcccagcagctttaggaggctgaggcgggaggattgcttgagcccaggagttcgagaccagccatgggaaacatggcaagacccccacctctacaaaaattaaagaagaaagtagccgtggtcccagctactcgggaaactgagacgagaggattgcttgaactggggaggtcgaggcttcagtgagccccgttcgcaccactcactgcactgtagcctgggcaacagagtgagaccctgtctcaaaaacaaaggaacaaaaaatttaagtctggcaaaattaaaggttcaaagtttcagacactctatcctgaccgctctgccctcccactcctaaataatataagggtccctatttcacggatttgggttaaaagtggcctgctattaatagttaatttttaacaattgctgtagttttcctttagcaaagaatataattggctaatttttttttcagtgtttagtctaaatttcccttagctttgattcctgtcacagatgtgaaagataatatttccaaacctcagaaattactctgtttctctccttagccaaaaggctttccccatggaatacttactcagccttaaggagtctcagcacctgcagacttggtggtagattccagcaggactcttcagcaacatccacacagtgtcttcttcttgggactcctctgggaccttttccatttattccattcttgcccaagataatacctgcaaccttatggtggatgtagagttccccagggtgtgttcttttcataatacaatttgattagaaaccaacagtgaaattgaatgtggaagatacgaaagcaaccacacttgtctcatttcccccttctcccccatcaccccttccctgagaaaaccccctaaatctcccagaaactatttaacctgagaatgagaattgttttcatagttactcccacccccagtcttggagacaaacagtagcaaataaatgagcttgacagtagagtaaaagctggaaacccctttggagagtgagtatgaatcatccatctcacactaaatacacgcatgtggactcatctcagtgaattgagggcttaaagttaaacatatgggattggagttgtgtgtccatagggtttcactgcctatttgatttgagtttatccctattaattttttacagtgaaattttattaaagtataatgtacatatattttcagtggattttgctctgaaggttctccagtggtctgactacgagatagtgcggcttcagctgtgggatattgcaggtaaagtgggagggctagataggaacaagggaagaaattttgatttaactagaaagctctgaggaaaaaatggggcagcaaagccagaaattgtttttctgaagctggaatgattgagctgctctgaggacacatgagctgaataggtgcagagcttttgtagatgttttgccctgaatagatctggagcagtctctatgtggatggaggggctggcaaggtggtggattgtccagactataggtggacactcccacagcaggggagggtgctttttctaggtttaaggctgaccttggtgaaaaacaagatccccagaaaatagatacagtaaaaatagtgaatccttactatgtgccaagcattcttctaagtattttaaattcactgactcattaatcctcacatcaaccctatcataaaagctactgcttttggagaattgcttgaacctgggaggtggaggttgcagtgagcctagatggcaccactgcactccagcctgggcaacaggagtgcaggaaactgtttcaaaaaaaaaaaaaaaaagcgactgcttttatcttcactttacaaatgagaaatctgaagcactgagagcttgatttgcccgaagtcaaatagtatgcagcagagcagggatttggactggagcaatctgggtgcggaatctgccttggaaataattgggcttcattatccctttatgggatagaaaaccaagagtcagagggggaaagtgagtggccccatctgacacatatgcttactgccctcttctacaaggaatggggagaggccggctcttgggtcaccttgagaactctcccctttctccccagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaaggtatgtggccaatctcagaaaatggtccctagcctctatctgtggttagaaaggaagtaaaatgctctctgattctgggcatccatttccccttcttaagttggcaaaatcatctctacctccttcaaaggatgttgagggtgagtgagactttctttcttttttttttttttgagacggagtctcgctctgttgctcaggctggagtgcagtggcgcgatctcggctcactgccagctctgcctcccaggttcacgccattctcttgcctcagcctcccgagtagctgggactacaggtgcccaccaccacacccagctaatttttttgtatttttagtagagactgggtttcattgtgttagccaggatggtctcgctctcctgacctcatgatctgcccgcctcagcctcccaaagtgctgggattacaggcgtgagccactgcgcccagccaagggtgagactttctttgggaagaatgttgattatagatttccgatgctggtgttcttatccattggtggaaatatgtttaaaatccacagtatctgagccatattctttcttagttgcaggaagtttatgatactgccttttattttttctctttgctagtgtgatctgtccccttgggcagtgagccgggaccagattgaccggttcagtaaagagaacggtttcacaggttggacagaaacatcagtcaaggagaacaaaaatattaatgaggctatgaggtaagtagctcatgctgataggcatgcagatgtatccatcttccactgtggccctgtggaccctcttttcttatttctgagccaacaatgacagactgagccattggaatgctagcccctaaaggtcagggatactgtctttcctgagataactggggacaaaggggcatttaaaccttctggctttaccaaatactctctgatgataagtcagactacatctgccatttctgcttttcctccaaaataagcttctcaggcttattttttgtcttttagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctgggggaggaaagtagatagacagaaaatcattaggtaatttaagtactaaattgggcagggctttttagtatcaaatcactactagaccatttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccagccgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggagactgaggcaggagaatcgcttgaacctgggagttagaggttgcagtgagctgagatcacaccattgcgcttcagcctgggcaacaagagtgaaactccatctccaaaaaaaaaaaacaaaaagaaaaa

SEQ ID NO: 9330 - DNA, 218 bp, Homo sapiens
aaggaacacctggcccgcccagggtggaaaaccgcttaaaggcattcttaagccacaaacaatagcatgagtgatctgtgccttaaggacatgctcctgctgcagttaactagcccaacctattcctttaattcggcccatcccttcgtttcccataagggatacttttagttaatttaatatctatagaaacaatgctaatgactggtttgctgtta

SEQ ID NO: 9331 - DNA, 33296 bp, Homo sapiens
gtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgaggtaggtttgtaatttcctattaagaatcagttccataattctagatttcctgattatttggtcaaatataaaatctttatttgttcttttctaaaggtattcagaagacagtttttctattctcaactagtatgaaatatcaacactatctcttgttagataaggacagtatttatggtcaaacatttttcataccagattatattaatacatgctgatctctcgacttgctggtctcttagagaagctccgtctgtactatttagaagttaggatttcaaataagaatgtgcattgcagtctttctatgagggtctgtgaaactttggtgatatttgctactgacgtctgtttctttctctctactgtcttcaatgttagcttcttgaggaaagaaccttactttatatccatgcctacatttgcagtgcatatttgtgaacggtatacagtgcacatttgtaaatggttgacatgcctactgtattgttaggcattgctagtgctgaaatataacgaatgaataagatactaatggacttaatgatttagaacaatttgttacacaatatcacaatataggctaaaagatactaataaaatattaagaatataactgaagctgttcccttggaggtaaggaggagggtaaagaaagcctacagaaaagggatatttgaaggtgagtagtaccttgttaagaggtagaagagacattggtagaggtatagaggtaacagaattagcagattcagggctacgtgaaagcacatggtatatattaagttgttcattatgaacagagtagagaatataattttgcgggagagttatgaaagggaagtttgctggaggcttggcccaatgcatttgtctttattccgtaggagagccatcagatgtctataagcaagggcttaagggtttttcccccaaaagtaagatagctttattgcttcacattttaaagtaatattcagaagtgtacctttaaaagacaaatggtgacacttttgagggaaaggctgaggatgggaagacctgtcaaaagcagtggatcaagtataaggaagataaaagctaaggtgtaggtagagaaaaaggtaggtgctaggtgttctgatgatttagaagtgaggacttggggaccaattgaatctgaagataaatgtggagagaatggctttatcaaatccagttgtgcaaactagaaaccttcattgttcataggaatagggaagttagagtagtaacttactgatattaaaatatgttatggaaatctattgtgttcattagatagcaatctgaagttgaaggaaatacactagtatggaatattgaacagtggttaactttgagggtaggcttatgaagagcaattttcctttttaatctttagtttccagattttctaaagttagacataaaggaattcagaaaggagtcatcagtgtataggtaataaaaggaagaagcaccaatgaagagagcaaagacatagaagtcaggaaaaagcaccaacgataatttcaggaagtcaatggtaaacatttttttagatgctacagaggtcaaataaaatgaagaatgaaaataagtcattcagttacaaaagcttcactgctatttcaagaagcgcttaggactttatttccaatttattgaaggattatgtaatagtgtcagtgaccttgctgtgcactagaattattccttaacaactaaaaactatagtaaaattatctatgtctcataaacagacactgttatttaattttaaggtaattgtagcatttagtttttctatttgtttcttcttaccttagctgatttttaaaaaataattttagactaattgttgtggattctgttggattagatagggaagattaacacaaattgaaaccacaattttatgttctgaagcataaaagattagatttttttttttttcctctctgagacagagtcttgctctgtcgccaaggctggagtgcagtggggtgatcttggctcactgcagcctctgcctcccaggttcaggtgattcttctgcctcagtctcctgagtagctgaaattacaggcgcgcatcaccatgcctggcttatttttgtatttttagtagagacggggtttcaccgtgttggccagtctggttttgaattcctgaccttgtgatccacccgcctcggcctcccaaagtgctgggattacaggcatgagccaccgtgcctggcaagattagatattaaggctttcatttcattgacatgatttatagaaatagatttaacgaagtcctttttgtttagtgtaatctttgtattctgaatattagtttactacatgaacattttaatatataaatgcatccatagctgtctaaaaattacatgtttacatatgtacaaagaaaccacaattgggatgaagattattggcagtaaaacatggctgtggttgtacagttgtgaaatagttcagttaaagggggcacacagctaagaaaacagatttggtaatgcaatggaacccccagattttaaaggggggttttgtaaaatcagtaaaaatagtacgtaattaggaacaaatatatatagaagggtagaattagccataaaatggcaagaaagaataaggcttataaagcatttgtttgagatgtgaaaatagacctgaattgtttggtgaatgatttgatccaggttagtctaaaggtgacagacaagagaaaagcaaaactagaaaattcctgtcgcgctcctagttttttctgctgaatgcaataattttcatacttgaaacatagcaaagcaagagaaaactgaggccccagatgagtgagaaaataacaggattacttggcggttgctagggtgctagttgctaggtgtgtgatagtagtcaaatagagacctatgacaggaactgtaaatgtcctgatttttcagtcagatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaaggtaggagaatgaatgattaaaagataaactacaaagagtctgataatttaaaattagtcaccaaattggaatactagattaaccaacagaaggcattttaaaagcattaggttatagtttttttatttgggaacaaacgatccattacggaggaactgaaagaaaacctgatttcgctaatgtgatttgtgaagaaatgatggggatgtgttttagttttacaaagttataaaacttcagtctacagaatcaaggagtgtaatcactcagtactttatattggtcgggtacattaagaatagtagtgaaatgcactttaatgaataattacttagaacctatccagaagacagcaattagtgttaaaaatggttgtgttcagaaaattggaagaaacagtggaagtcaaggggaggtatgtctgagaatacagagtagttttctaaagatcttatggtgaaataggctaccttttccaaattgattgtcaatcagtagaagccaagcagaccagattaggggggaaaaacaacttagatgttgtaataaattacaaagcatagatttccaccccctctccccaaaggaacttggaaaccagttaggtgctcccactttacttttgaggaaaaaatcccagagatgttaaaagtacttgagagtcaggactgaaagccagtcttttgacttttatgttcttcagggaactttaatcaatttcttgagttacaaatgaagtttaaatttgacctgagatttgttccatttctgcttttattaaaggaggactaattttgtcaatgactttttcagtttaaaagtaaatatgtagaaaagggtagaaggtctaaactttatgaggctggagatatttgtctgttgtgttacctactatatgagtagaacctaaaataatgctgatgcattgtatgaacttaattgtggttgaatgaataaggcagtggttaagaatggagtcagaactggattctgttcccacatttgccatttttagcgctgtgcccttaagatggctaagtgttttctcatctgtgaacattagattttctggtctttaaatacatttgaaatcatactgtataaatatcttatgtctcatttcctattacagaataagcattttccacatattgtttccaatgaccacatagcattacataagttacaatgacgtcttgagctataaagtgtgttagactttatattatttccaggaatttgctacaaaaatatatttgttaaaatacttgtgtataaagcttttttcacatttcagatttccccaggagagcttttctgcaatgcagttattaagaaaaatatctccacattttgatacatgttgctaaattgcatttctaaaaggttgtaccaatttactaccataaaagtggtgtgtgtgttgttcttagctcactttttcattattttaaaatcttacgtctttgctagtttggtatatgaaagtattaatttgctttatctggattttttattgcaaaaattcaagtttttttttaatgtttaatgttttagcttttgtgtataaagtttaataattgatattcaagaatgatttatttgctcacttaatcagtaattcaacatatgagtgcctgctctgtgccaggcactgtttatctaaaatctagggatttagctttgaattgaaagttctgcccctcaagaagcttatattctggtaatttaattgtactgatttgccctatctactctggtgtatttacacttttcccccaggtttgagtataaaagcttgtgctttttgtataatcagatatcagtcccttgtgatttttttttaattgatttcaaatctagaaagttccgcccttgcaaagattttacaaatatactcatccatgggggtgtgtgtgtatgttttggggtttttgtttgtttgtttttgttgttttgtttttgtttttgttttgagacagggtctcactctgtcacccaggctggagtacggtgtcaggatcatggcttgacctcccaggctctggtgaacctcccaccccagcctcttgagtagctggaactataggcatccagctaattttggctaatttttgtatttttttgtagagacagggttttgccatgtgcctaggctggtctcaaattcctgggctcaggtgatctgccacctcggcctctcaaagtgctaggattacaaacgtgaaccactgagcctggctggtttttaaatattttttaagacattaaactcggttcatttgaatacatttttacatgctgttaggcaagcaactaaattgtggatttttttcccccctatttaaagaagaagtcaagtaacatttacctactgggtccttcctaccaccacctttgttagcatctttaattttttataaacaaggttctgttaaattatctacttccatttgtcctatactttcatgtaattgtttttgtgataacttccattttgcttgttttttgatggtgctgattaagaaatatttgcaatgccattaaaatatagtttagccaaattattaggaattctttgaaaagtattaacatgtcacatgtcacatcaacttatctaaagttgtttgagtggtgtgtttccctttggaaaaataaaataaaggcttcctccaaatggataaaggctagggaaagagagctctagtcagcaaagattctgggagaaggggaaggctttttcaactcttttggtatgtgtctagggatgagacggagactcgaacagtagagcccagattccaacattcttgttggggaacaacttagagtcttaaaatgctagctttgatgctttctaattctggttcagtctccctttgggtgagaaaaagaggatttctatctcctacctgcagtgatgtgtggcaggattggagacttgagaatggggatattttgcagctttaaggcatatatatttcagatcatatcattgtgttcttgtttaatagtaatcagaactatagtctaaacatgaggccaagtgcagtggctcacgcctgtaatcccatcactttgggaggccagggcgcagtgcaggggccggatcacttgaggtcaggagttccgagaacagcctggtcaacatggtgaaaccccgtctctactaaaaatacaaaatttggctgggtttggtggcgcacacctgtagtcccagctacttgggagactgaggcagagggatcacttgaacccaggaggcagaggttgcagtgagccaatatcgtaccactgcactccaggctgggtgacagcgagactccatctcaaaaataaattaattcagcctgggtgacagagcaagactgtgtctcaaaaataaattaattaattaaataaacaaacaaacatgaaagaagcacagcttgaaagtccctcagtgatctagaataatggttctcaagttaattttatactgcttgtcagttaaaaacatgtattttcgatatgtgtatatgtttacaaattgtgtaattataattctgtgtctgcattgtaaaacacagtggtacaaataggaaaaatgtgaagtgagggatattataaaaagtttacttgtgcagaaatgttctgttagaaatactatgttctggattgctggtttttaagtgtttaattttaaaaagctttataatatcatgaattagtatcagggaaatctacatttgtgtgttgtattgcaactaatttaagtccatgtcatagtcttgatcttaactgtttggcatacttaccatatctcgttagatggtttcttaatgtggaggttgaagaactagtactaggaatagaaatgtcagttcccttgctctttgcatgtgcttgccttatcttccatctgaggttcttctgcgggaatctttcaaccatttgtctatttgggcttttttgtttttctgggatggagtcttgctgtgttgcccaggctggagtgcagtagcacaatttcggctcactgcaacctccgcctcctgggttcaagcaattctcatgcctccccctcctgagtagctgggactacagacccatgccaccatgcctggctaaattttgtatttttggtagagacaggctttcaccatgttggccgtgcttgtcccaaactcctgacctcatgtccaccccggcctccctgtgctgggattacaggtgtgagccactgcatccggcctcatttgtcttatttgtgaaggtagcttagttacactagataactaaatttatatatctccttatcgggcatacggtaatacggtaagagcaaatgagtgaggacttcactgttggcctcttttggagttctccactctttcctcagaatacctgagtaatacatgatactcatagaccatctgacataccaactcggtgaaacctagactataaatacatagtaaatatttataaaagctcatttttatctctgggcagaaaaatagtcccagttattttcttctgcaccccattgggttatcagtgtgtactctagggagactagtgactaaaaatgataggttctatttaaagttgatcggcattgaaaagaaattggactgaatagtctcactccaacaaccatcaagagtctttgtggcattttcagaattgttgatgtcatcgtatgttttaatggctttaaaaaaaatacatttcaccttttatagtaatgttaattctatgtatttcctgtcaatagaaatctaatttatatttcgctaaacccaagctaaaaatatatattgactgtgaaatgtgcattaaattgttattgatcatagttatcaacattatgctatgttataacagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctgtaagtcaggaaagcagtcatctcagcttaccttgctttgtgttaagagcatgacctaggattgccactcattctggttgaaatatcttgccgactcaccttctaacttcccgaatcatttttttcaccttcactcttgaaagataacttcagtagattagggtcttactgcccaaagtatatctaagaatcagaagcattattatcaccttggatcttaataaagatggaaaatttcaaatccccatacctactgagtctgattttatattttaacttctcatttgagaagccctggtttacagccagaccttcttggtttgaatcttctactatttgactttggcaagtcatttaacttctctgtgtctgttttctcattggtaaaatgaggcgaatacaatactttcttgtgggcttttgtgaaagttaaatgagttaatatatgttaaacacagaacagtggctagtgtagaagaattaggacgtaaccacctacaggtgtggtggctttgatttacgtgatttgaccatcacacatatcgttgactcaaactttggtttatctttctagaatttgttactcttttttcctagtgaaaatatatcctttttattaataatgcccaacattccacttaaatggaaatacttataaatcagattttcagtgaaagggtctaaaacataattgtaatgatttagaaatgtcattactgtggtaaattatagacctaggctttgctaaggatttcgtcctgttttgtgcttcacttatagtttttgttgttttactcaaagaagggaaatggaacatccaatgtgatagtattttatgacctaggcagattccattatattgcttttaaatagctcctatttcactaaagaatgggaacgaagtgatagttacagatttcatcagtatgtaaaaagtgaagggtttcttttaggtaaagatttctttaaatgtacctgtgaaatgattcagcatttttaaaatggaaatgcttttgctgtcttggagttttgttgtttcagaagttttctactgcactattttggatagtctttcattaaaggacctaagcatgaattactctgaaattttctagtttaagtattgcatagaaagttcattttattgtgttaatctctactaacttgaaatatgccttccaaatgcatgacttactaaacagtattaaggtattggctgaagtttcaaaatagcgttaccaaatctcttaagagtctttggtagtttgtggtcgctgtctcttaatattaattacctttgttctgaaattgttgttttagtaattttcacttcatgtaaaggcagcatttgctaatgtagttgctataccttaatattaaaccccagaaattctatttttgtctgataagtggaaattctaccataatttggggcaattccccaatataataagttgtttcctctgaaatgttttattagctaaattaatgctgcagtaataaagtctataatcttcccttcattttacttttttttgcgtttttatatggaagatttagtgacttattaaccagacttaatatgctatggagataatgtacagatatgtatatattctttttctttttaaaacagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggaggtaatctgtcagttctcctttgtaaaaatgtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctggctaacacggtgaaaccccgtctctactaaaaatacaaaaaattagctgggcgtggtggcaggcacctgtagtcccagctactcgggaggctgaagcaggagaatggtgtgaacctgggaggcggagcttgcagtaagccaagatgccaccactgcactccagcctgggcgacagagcgagaccccgtctcaaaaaaaaaaaaagtcacctcttagattatatggaaattcattgtggctgacaccatacaaattatttcacaggcctggcatggtggctcatgcctgtattcccagcattttgggaggccagggcaagtggattgcttgagctcaggaattcaagaccagcttgcagcctgggcaacatggcaaaaccccatctctacaaaaaatgcaaaaattagctgaggaacgtgacatgtgcctgtagtcccagctactaagtagactgaggtgggaggatcgcttgagcccgcaaggtagaggttgcagtgagctgagatcgtgccgctgcactccagcttgggtgacagggagactctgtctcaaaaaaaaaaaaaaaaaaaaaaaaaaaaagtttttacatgtgaagtgtttggcttactaaaggactgaaattatgaggcctctgtgcatttttaaaaaacgtttgagaaaagagtcagtataatagctaacaagatgcatgctataggaacattgttttggttaatcctcatggcagtcctgttaggaattattctccttttacataagagaaaactgaggtacagaggagtttaaaaaaaaaactcgccaaaggttatgattgttaagtcatctcatttgtagtatgtgtaaatgccataaaaactaagattaagacatggctatcttagcataagatggtggttctgaaacatttgtgtgtatcagaattagtggaaggcttgttaaaacacagattgctatacttgatccccagagtttgtctttggctaggactagagttaggcccagtatttcttttaagctcccaggtgatgttaatgctgctggtccagggaccacactttgaaaaccactggtctaaggcaattcaaatgctatgttaagtatagcttggaagcaatatatcgtttcgcaaaaatcagttcaacaaacataacacattatttatttttagatgatgttgaatttgaagtatcatcggaccgacggactgggaaacccattgctgttaaactggtgaagataaaacaagaaatcctccctgaagaacgaatgaatggacaagttagtgactttgatgctttgtgtttttttagggccctgcatttgcatatctttcacattagaaaaggaagattctccccatctcctcagtttgcacgaaagagagctatagtatataaagattactattttaaaattaatcaaaagcactggcatttcttgacctgaaataaaaatatggtcaagactcaattgggtttttacatataaccctgagtcaatgcttacagtcaatttacatactgtaagtttgaaacttggcagcatgacatcctcttgtggatcatattaaaatgcatccctgtatatagtatagaggatattaaaattcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccaccatgtgatctataagcgtactttaaaattcaaaatagaaaacgtaagctgcaattgttaaaatcagttttaaatttggtttctaagaggcttcaaatgcagcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggtggaagtggtagacttttgaaaggtggggatgctgttgaccagaggcagtgatgtgagagttaacgtgaaagatgaccgcctgatatggatagactaagaggatggggtggaggagtcaagtcatattgagaagatagaatcatcaatcttaattgatttgataaaggtggggttggaattaaagggagtcccaaatactgtttttctggcctggcctactgggcagatgatggtaccataaactgggctaaggagacataaggagaatgttcaaggtgggaaaagaatcatacttatcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgtaccttccagtagcatgtggagggaaaagtcctaagagcatgtctgggattatctgccttgaaccttatctctttcttggcaagccttgaaggaatcagattgtgttgtaggtgtggttattattagttacagtctgaaggcctcaatttatatagttgttaatctcagaacagccttacctggtaagtttcttcatctgtaaaatgacgtataagttctcacaaagttacttgtcgatgttcatactgcttttaaatagcaggcatttaaattcccatctgactctaaagcgttttcactgcagtaagttacaaaaacaggtagaatttttctggtgtctttgttagtctgtaacatttttttaaataaaaagcacattttgggttatttgtctgtgaaaaattaagggaagtaattgcttggtgtataggtcttttcttaaaacatttagactaacagtaccattatgtcttatacagtctatgttatcttaaaaacaaaattgaatttacatcgctgctacacaaatatgaaggcataaaagcaacatgtggtgtctctaacttgtttccattctccaatggaggtggatatcattacttttaaaagcatagcaagttctcttaaagtcacttcatttactcaacttttatggctgtttactcagaaataattaatgagatagctactaaatttagcactcactgaaaatagagaccatctcctatttatctctgtatcaccagtaccttactttgccgcagattatacctacacaaatgtttgtttaatgaataacctttataagactttagtattccccacctttggtagcattcgctttgtggctttatttcagttattttgttgaaatagaaaaacagagtagaacatcacgcacccatgtgtaagtttgtaaaaaagcaaatcttccaacaacagtcccagagaaagatgacctatatatatatttgccaaacgtagaaggctaaggagttaaagtcctttgcatataaagccatatgaaaataatcaaatgtcataaaccctgtatttattcttagtgatgatagaattcttaaagccccaggaaactagtttctttagactcatatctaagcaggccaatacatttttaatccctgtttcattcctcctccctgcaattattttttttctagtactggtgctgtaagtgctcgcaacattatgctgttgaaaaagaaacaagcccgctgtcagggagtagtttgtgccatgaaggtaagtgttaaatttgagaaacttgagttttctttggccacttgaaatgttgtacttcaaactccagcctttgtttttttttttcttttttatcttacccttttaaaatatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagtgcagtggcgcgatctcggctcactgcaacctccgcctcccgggtttaagcgattctcctgcctcagcctcccaagtagctgggactacaagggcatgccaccacacccagctaatttttgtattcttagtaaagacggggtttcaccctgttggcaaggatggtctcgatctcttgaccttgcgatctgtccaccttggcctcccaaagtgctgggattacaagtatgagccacctcgcccagccaaatatgtatttttttttactgggtgatgaaaaaaggccaaagaagaaaatgctaattaaattggaaagcacctgattggattagactgcagttcaggtgtacatttgttccctcctctgcccctgccctacccctccagtttgtggggaaggtgaggacacaagtggtgtcattcctggaaaaattccttaaataaaatcttttggtaccagagtgctgggtcttaattgcattgttgtaattttatggttgactcgtgtgaccatagaccatgaagctttcacattggacttatgttgtcaacaccttttttcgcttcagggaactaagttaaaaataacatgggtttactatgtgttcttcttgtttgacttagaactaggaaggatgagaaatctccagctaaaatcgtttttccttctcatcagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatggtaagtgttggatattactggatatgtatctaatatgcgaaagccaatgttatattcaagtttatactactaaattaaaatttttcttaagttaaatgaccctaatgggcatttaccttgttaaggtgattaagaatcatacacatttgagtcagtctgggttatctctggcagttatcttggaaatatatgtgaaaaaattttttgaatggaaatctggacaggattactaagatatttttagagtcagtgattctcaggcccttaatatgaagagtaagaaaattcaagttcatcattgtagaaagtagattttcccaaactatttcctaagacatttaattagtggtttctgtttttaggaaacacaattcttcctccagtgtggtccagggaagccaaaagattgaacacccatgatctagacactagatcacacataaaatacactaacagcaatgatagctgatgagcttttttaaaaaaaaaatcataggcacggtggctcacacctgtaatcccagcactttgggaggctgaggcgggtgatcacttgaggtcaggagttcaagaccagcctggccaacatggtaaaaccccgtctctactaaaaatagaaaaattagccaggtgtgacggtgggcacctgtaatcctaactactcaggaggctgagacaggagaatcgcttgaacctaggaggcagaggttgcagtaagccaataccatgccgttgccctgcaacctgggtgacagaggaagactgtctcaaaaaaataattgcaaaaacatctcatcatgttttaagaaggtttaacaatttgttgtgttgggccacattcagagctgtcctaggccatggtttggacaagcttgcaattaaaccagagtcaaaaaggttttgttttggcagaacttcacaaattgttttttaagagtttgtgtctgggagtggcataaaccaaccagattttttcccaaacatgttttatgaactcattttctcagacataatttgcatttagttacgtttgggatcatatcatctacactataactcagtgttgccagtggaactgggtacattgaatgaaaatttaagtttcttgagttttttttaatcctttgcctttgaagaactggttgtatttgacacagtgtatttaactttaaaagtttgtaagtctgaatgtgtgatttttttttttttttttacattttcaaaggcaagatctgttttgctttacggtatggaaaatataacttggctactgtcaggacttggcaaggattaaatgtcaaaatattgtttaggtcatatttaaaacttacagaatcacttctgcagtgagcagatatgtagtatgtaatacaatagcagattgataatttgtgttcattgtttcattaaacatgagtatctaccatgttccaggtactcttgatacagtaagccttacaaagctgataatttagtaagaaggaaaaaaaaaaaagagaaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggcagagcttttagtgagctgagatggcgccattgcactccatcctgggcgactgagtgagactccgtctccaaaaaaaaaatttagaccttgttctgtacttcaaggaaaagatttcttttggataatgacatcaggtatgtgctttgggagagtaatggcagcaatatgaagcctagatgggatggagaaagacaaaagatgaaaaggattactatgaaattacttggatagttaaggtagtccttgaactaggcacacagatagtgactatagacaagtgaaggtacatgagagatactggaaagtcatgttataatttaataattgctattagccagaaagagcaaggctagtatcttgcttatcacttactgtagcttgggaaattatttcacctctgagcttcagtttttaaatttcaaaaatgattgtgtaatagtttaaaaagccctcgaagtacctagctcataataggaatttcgcatgtgacagatgatactgttaacaaaaataaaaatacacttcagttgggcttatttttaataacttttaattcttggaatgctctgcttcccaaatgtgtctggcaaaactggcttgatgaagagagcctttgtgtgagactttccctgccattttttgtttttttttctttcttagtccaacagtaccctagtaaatcctctgtcatcatgcttcttacagtatataacatttacctgttaatgaatctgtctctgctgcactggactccctcagggcagggattctcctatctctatttaatatatttgatgtatagtatattgtcagctgttgatgttgaagttggtgagttaagagcaaaaggtgaacagtaagcttttgagtttggttgtggaaaagttgatgacattggagtcagacctgagttcactgacattgttcttaaccaaactcaaatcctctggattattttgcgctgggttttgtaaccttggtaaggtttacttaattcctcagatttccccaatttgtaaaatgagggaaaagagaaactatggagatgattttgtacaagattaatttgataatacataatacctggtaatgttgtaagtgttcaataaattattatatagcagttatggaaggaatgtgattggtagaagaggaaaatgaattggttttgaatatatcgtagtttgtaatgaggactggagtttaggaaggaagtcagggctagagtagggacatgggcattatcttcatagaaatgttgaaaccataaaatcagtataatttatgtagttgctgtacactgtcattacttaacggtgtgattcaatacgacacacctgaactttcttagacttttatttttttagtcaagtgcagtagtgagaaggggggaaagaggagaacaaggaagttcgatctgtaactgactgaacaatcgagataacccactaccttcagaccagcccttagattttttaagagttaatcattcttacacgtacgatgactgaaatgttgtttctccttgaagtctggtattaaaaaaaattgttgaaatactagtatgtcataatttttaatcatctactttatgtcaagtacttgaactgtgctagatcatacaccaaattatcctgcattgttaagtatattgattgacattatatattaaatactgtgcaaggtgctgtgtgctactaaaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggttgcagtaagctgagatcgcaccactgtactccagcctagccaacagagtgagactctgtctcaaaaaaaaaaatagaaagtaagggttcttagaaccagacagttcagtttttgaatccaggccctgccactttatacctgtgtaatttttaccaaataacttcttggtatcttagtttcattatcctgaagttagggataatgttacctcttcatggggcattcttgaggattaaatgagtcaatacatagaaattacttaaaatggtgtctaatgtaaataagcatgccatgccatgactgttactgtaaaataaagactgcctgttactgttgatgtttatggtaatgtttagttaaatgtcatttcctttctccttagtgagttctctggtgatgttgatagcctggaactgggggacatggtcgagtatagcttgtccaaaggcaaaggcaacaaagtcagtgcagaaaaagtgaacaaaacacactcaggtaataaattgtgacttcttattcagcctgtgcttttaagtgggagataaaggatggagtagtagagggagatgaggcctaattattctacatcagtcattctcatgtgcgattccatagaacagcagcatcacctggttgcttgttagaaatatacgttctctgaccctatcccatacccactgaaactctgtgagtgggcattcttttttaataaatcctttaggtgattctggtatacactgaagtttgagaaggattggcctagatattttaggaaatttgctttatattttcaattcattgtcttcttttgaaaaataaacccaggatagccagctgtggtagtggatgcctgtagtcacagttacttgggaggctgaggtgggagggccgcttgtgctggtaggttgagactgcagtgagccatgatgatcctaccactgcactccaacctgggtgacagagcaagactgtctgaaaaaaacaaaaataaccccaagatatgtatacatcaccatggagtagggaagagaggcatttccctagaagattgttttgaagaagaatgaatctaaatgtgaaaaataatgggaagttaaaaaaattaattgtaatttaggatcttggatctctgactttaaaagacctgcaacttatttttggctctcatctgaactcttaagtgtgtgttatgttttagacactggggatacagcagtgaagaaatcagatacatccctgtattcattgaccttattttttggtggaaaatatggggcagactagaggagtaaaatactgtatatgatgtttagaaagacaacaatacatgtaataaagatgaatcaggacagtatgtaagtattgtgatttacattttagagaccaggaaaggcttcttaaaaaatgacatatggtcacctggaaaaagtaagagatcaaggcatgttttatttatgaatacttattaattccttaaacaattttatttaaacaattctatttaggaaaagcaggcattttggtagtttagaagtatttaaagtccagcagctgttctaaaaatagaacttggcttcaggttccctaccccatttcaatagcagccagccaacctaccctgttaacatttgtgctgttattttttgcttacttgtctttctatgtagtagagatgaaataaaattgaaagatgtacctgcctttgttttgtagtgaatggcattactgaggaagctgatcccaccatttactctggcaaagtaattcgccccctgaggagtgttgatccaacacagactgagtaccaaggaatgattgagattgtggaggagggtaaggatcatcactatcaggctgtttgaaatttgccataacttcagatgagcacctataaagttttaaaatatggtgcttattgcagttgtttttaggtttaaaactgaattaaggaaaagtgacctctctcatgcttgctttttatttttataccccttgaaaatgaggtcagtctgggtttaaatagtgaaaacgtgactgctttgtgagcacatgactgatacatgagcaactatgagttatattgagatagacttaacaacaaactctgataaccaaagcttttactgttgagtgtatgataatcaaatattcagttccttcattagtatttaaatcagtaagcattcagttctgtatttttgcttcctgtaaaagtttactgtttttttcccccctacactacacatatgtacataatctgtttcttaatagctagagttctatgaggatcctatttctcgtttctagctcaggcttcctttcattctctactttcttcttcttttttccccatctatcttcaagaattcccagagttccagtgccgctgttcccccaacagtcaccatcagaaaggccaactttgtatgatctgtatgcataaaataaatacatgatagaaataggagagaactctgtagatgattaggatagcagaattacatgatgtggagtagatgagagggcttgagtattccaaccaaagatgatggcttggtaggccgggcgtggtggttcacgcctgtaatcccagcactttgggaggctgaggcgggcggatcacgaggccaggagttcgtgaccagcctggccagcatggtgaaaccccgtctctactattaaaaaaactaataataaaaaaattttaaaaagaaaagatgatggcttggtttacaaagagaataaagtccttgcatcatctaagagtcagcgaacataaagtgctgaatagcaggtcatttgggagaaggaaatgaaccttgataacctattcctttaccacatgggattcttagaatttctgttctacataaaaccactgttctcccacctctaaatatgaatttttaaacaaatgccatgacatcacacccctaaaaaggccatgggagtatggactactaactttaactcataatatgatatcaaattgcccttccatctcctaacgtgctgcttttacttccttttccatccccacttcccagtccactcattcttcagcactggctgtgggatatagtccaaagcaagggttttatttaggcatctctaagcctggtgggatatagtccaaagcaagggttttgtttaggcatctctaagcccgggactagacagattacattttcccacttggtaagaactagctcttttattcaggaacacaactgtaacttatactaagactttgaagttgggcagacctagatctggacaccgttctagcatataatcttggacaaataacttaaatctttgctagctcagtttcttcatctttaaaatggtaataccttcagccttagatggttctataaagtatgaatcagtatgtgcatcataaatggtaattattgatattgcatgaggtcagaccagcttcctctaatcactcttcccatgacttgatctctttggattatctcctcaaagttttttggttcctgtatttaaaattaaaagtcagctggggtcgagagtaggggctcacacctgtaatcccagcactttgggaagccaaggcaggcagatcacctgaaggtcaggagttcgagaccagcctggccaacatggcgaaaccctgtctctcctaaaaatacaaaaattagccaggtatcatggtgggtgcctataatcccagctacttcagaggctgaggcaggagaatcacttgaacctgggaggcggaagttgcagtgagctgaatcatgccactgaactccagcctggttaacagagcatgactccgtctcaaaaaaaaaaaaaaaagtcaggtgtggtggctcacacctgtaaacccaacacttcgggaggccaaggtgggcagatcacttgagcccaggagtttgagaccagcctgggcaacatggcaaaaccctgtctctacaaaaaatgcaaaaattagccagtcatggtgtgtgcctgtagtcccagcgactcaggagctgaggtgggaggatcacccgagcccaggaaatcaaggctgcagtgagccgttgatcgccactgcactccagcctgggtagcagagcgagaccctgtctcaacaataacaatgacaaaaattcttcacttaccctgtaatcatcaagaggatggttagaagcttctgcttcccacctgtttttctcatgttttccactattgttgactgagtacatttgcctggatgctgaaaattgttaggcagctgaattctttggcatagtttttatctgtagcctgcaccgggctccaggcaacttcatactgtagggcagggctcagcatatatggtggccttttcttgtgatcacagccacaaccatttgtttacatattgtttttcgttgctttctcactacaacagcagagttggttagacaggatgacttgcaaacctaaaataatactctccggccctttaggaaaatggtttttggtctctgatctggaaaaaggaacctatgtgagggagccagaattcgaacaaaaaaaaaggaggtggggtgtcaaatttatctaaattgtttttgcctgtgcccgcctagttgtttactggctcattgagtatgggacaaaagtatttttggttggctcatattgtgaacttgggaagaagatagtcctgtgaatattggcaacccatagtgcttaaaatttaggcaatgggattgtaaatgacagtattttttgttttaatttataaatgcagtttaaaattgttcatcagctaataaagtactgatgggagctgtgacattctcatttggttccatggtagtatttaacatttaggatttcatttaagctttaaggtgaaacttctgagtactgaaaatgtaaatatattttaagtaacataacacatttttagcagttatataaacttcctagggtcatcagcagaggactgttgtgaaatactagcttttagactttgtacctgttttacaggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagcttcttttgcatatcacacaaacacagaaaccacgttcaaaagtacttaaaaaataagcttagggcaaacaaacttagtcttactcctgagatctcagggaaatctgagtcctcagaatgtttttcatcagtacagagaataataacattttgtatggctgctactataacccagcttaattctagaggggatccaaacaatatatatgttgaagtaacagcttcctgatgagtttgcttaattcaaaaagcttagttcataatatacgaaggaacaaggcaagttttatttgtttggttcaagtttgtgatatagtgaatggcactttcagagatacatttcttccctgacaggttttgccacaggcagctggactggagtatcaacattaataccatgttttatacatccttttagataggggcaggcattgtgcttcattcagagtgaggtgtggcatgccctctcttttttacctacttttttttttcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctggtgagttttgttgttgtggtttgattagtaactaccctggagtgtctcaactttatagtctctgttttgtcacatcacttttctgtgccttgtcttctgccacttattatttcttgatacttcctacttctagttgaatacaaaaagattgtttagtacatgttttttaaaatttttgccaaattcttcttcttccattaagtcatttctaggttatatgctacttaaaattctaatagtttagccatgctgattcataatgccgctttgcttccccagagacagtctcacagtctgattcggttacccaggcgctatcacgactcactgcagactcaaccccctgggcctaagcaattctcccacgtcagcttccccagtagctgggactacaagcatgcgccaccacatgcagccaattttattttttgtagagacatggtcccactgttttgcccaggctgatctcgaacttctgggctcaagtgttcctcctgccctgtcctctcaaagcgctgggattacaggtgttagctaccacatctgctaccttgtttttttatgcatctgtggaactggtcactcttgattgcattcaagtctagggtctgcaaatgattccttccattcctattaagttgggaccttgagttggggataataatacataaacaaacttgtctgtcctgtctttctagctaggtatatgaggcaagagtcccatcataaaaagtgagtcatttgggcagttaggtggaaaacacactcctttgcaagtgcttgctgtctgcccaccaagtgtggtttcttctcatcttttgacttaattacagtgagggccccaaggctgttgcagctcctcgacctgatcggttggtcaatcgcttgaagaatatcactctggatgatgccagtgctcctcgcctaatggttcttcgtcagccaaggggaccagataactcaatggtatgagggcatacaaggcttgggggaggccaactgatagaccaacataaaatatgtggtcctatttaaacaataggtcaggaaacttaatgaagcagggagacttccatattgcttataactagttaggactttctacacattggttcagccccctaacctaatggttgcttacagtaagaagcacatttcttttcttgatgctttgaagacagtttaggtaatgaatgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagca

SEQ ID NO: 9332 - DNA, 625 bp, Homo sapiens
gggcttagaaaatcatagaatgcatggtcgctgctctgaagaaagaatttagtggcatattctcgcttgacttatgtgctgtttcatgcctagaatactcagctattttctttctcctagaattctgcctgattttccaggttcacttcaaattccacttatttaaaagccttggttgctttgatggacatgcagttgtggataaacaataaataatatttctagatagtctgtgacataatagatacctagatactaattgagcaaaataatttttggcatttttgtcctatactctgttttttttttccatgtttacatcttgtcttttcagcaagattgtctatgctctcatggcagggacttcttttatgttttccacagagctagatccttataaaatacttgcactaaattaaacattatgccatgtaactgagcttatttgggggaagaggtcaataaagactatggaataatttgaggtcttgggtatgagataccaaaggaggtagttgctagtacttgagagattgctccaaataacatcagatgagcatgcttccaagtttcctgcattacttgcatgacccatgattctaagttaatgaaatgagtttgtccc

SEQ ID NO: 9333 - DNA, 12301 bp, Homo sapiens
cgctccttggtgggggctgttcatggcggttccggggtctccaacatttttcccggctgtggtcctaaatctgtccaaagcagaggcagtggagcttgaggtaagtttatctcatgcatagtgttcggctttgggctgtggaatgttcaggcgtttcactgatgccagaaatggagcagaatctatcagctggagacaaaggccttgggcgggggtccttccatttggtgcctacgtggggagatctttggagacagaagggagaatgggaaggagttgcggcctggaggcttcctgctagagctgagaagccttcggggagtaataggaagggggatttccattgcttaggctgagggcggggcccaaggactgttgaaaaatagctaaggatgggggttgctagaaaactactccagaagtgtgaggccgatattaatccggtgtttttgcgttctctagtcactttaagaaccaaatggaaggtcacactagggttttcatttccattgattatagaaagctttaaagtactgtagatgtggctcgccaattaaccctgattactggtttccaacaggttcttgctggtgtgaaatgactgagtacaaactggtggtggttggagcaggtggtgttgggaaaagcgcactgacaatccagctaatccagaaccactttgtagatgaatatgatcccaccatagaggtgaggcccagtggtagcccgctgacctgatcctgtctctcacttgtcggatcatctttacccatattctgtattaaaggaataagaggagagaaagtaaaaagttattttgggtatacattcagttatgcaataagcttaacgtgtttatagagaacagttcatttttattagctgctgaagtttctaaaacctgtccagtttttaacagttctgtaaactattgcaaactcagtgttgagttcattcatgagtttcttcatatataacagctctattacatgagaaacacaggccatagtagcgagactgtctgattgtatgggagataataggatggagataaaggattcagagatgagtgttcttcaatatttatttattagctagttgaagcagctgagaccagatgattggagtagcaagaacttgagatttttagtctttatgcctaggattttggtccctgtttgcagtttatttagttgtgtgatattgagcaactgaatctctcccaacctcattttcctcatgttttaaattaccataaacttgtcctgcctaccacacagggatgttatggaaagttaaataatatatttaagttatttatgaatggtaaagcactatgtaatagtacttagggattctattgttattatgagagttcatggtacagattgtcttcagtaagtggcacctaaggctctttaaataaagggttttgccggacacggtggctcacgcctgtaatcccagcactttgggaggctgaggcaggcggatcacaaggtcaggagttcaagaccagcctgatcaacatggtgaaaccccgtctctactaaaaatacaaaaattagctgggtgtggtggcaggcacctgtaatcccagctactcaggaggctgaggcaggagaatcgcttgaaccagaggcagagggtgcagtgagccgagatcacaccacagacctccagcctgggcaacagagcgagacttcgtctcaaaaaataaataaatagataaataaataaagggttttgtaattttgttcagtttagaaatgcctaactttagagattattttaatcaacacctggcctccctaccatctggctactcgtgtttaattgatgaaaactaactctaatgtagccactataaaaaattggttgctaacccttggcaaaatctttattttgagcttaacagctttaatattttacatgaaatgtttaatattttaattaaatatttttaaatgtttgatttattgagcaatttacataagtaaaatacataaattttatgtctacagcccagtgctttttgcgtttctatatagtcatgtagctaccacccagataacagtatagagcacttccagtactccagagagttctccaagtgtgatgacattaaaatacaagtaaaagtcctgttgccataaaaccaaaatgaaagtattttttatatgatctatgcatgtttgtcttcctgagaaattaaacataactataccttgtttggaacctttaagaatttgattcaggaatatttcccaaaggtacatctgtcatgataaaaaaaaaaccttctctgaaacaaaggtatttgtatatttagtcataaacacaaatgatgtatatagggccaggttataattggtggaggtatgtttagatttctttaagtaaaataaacagcacaaataaaacagtccagttcatagcttagtgaaatacactgggtacttaatctgtagcctcctggctgcagtagagttgtcatttgagttactgtgttttcttaatcttttccaggaacacagtgaccatatttcttttctgcaggcatatagaatttggtgggttttcttttatgtagggtgatattggatactttttgtttgtgattatatattagcaatttgagggacaaaccagataggcagaaatgggcttgaatagttagatgcttatttaaccttggcaatagcattgcattccctgtggtttttaataaaaattgaacttccctccctccctgcccccttaccctccacacccccaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacaggtactaggagcattattttctctgaaaggatgatctttgtgttctgaatctttatggggaaatgaggttaccacactagggaagatagagctttttaattatgggaagagttggttttaggttgtttgacattgagaatctagggtaattactgaaagttaatactggaatttattttacataatatactgttactataaagtttgataatacataagtgaagcttgctactgggaatgacttggaaccagagttgttgtaattagagatcacgaaggaatttcagagaggaaaacatctccaagaaacatctttcagtatgtaatggaaaagataggccaggcacagtggctcacacctggaatgtcagtgctttgggaggccaaggcgggaggatcactttcagcccaggagttggagaccagcctgggcaacagagcaagaccctgtctctacaaaaataaaaataaaaaaattagtcacacatggtggcagctactcgggaggcagaggtgggaggatcacgtgagctcaggaggtcgaggcatgctcactccactgcactgctgcactccagcctaatcaacagagcaagattctgtctccaaaaaaaataaaaaataaaatgataggagtaagcaaataggaagtccataaagatgaaaacaaagcaagggaacataaagatagactttgtccatagaaccataaagtttcaaagctagattggaccataaaaattctagtacaatattcttattttgcagaatcagaaacagagttcagaatgtcgtttgttaggttttggagtcaggattgttattagtagcagagccaggaccaaaaacccaaagctcctttttcttagcacagtgttcttaaacagaataatataatggttaagaatgagaactctgcctggattgaaacctagctctgtttattagcgacgtgactcaggggctatgtggctttcctaacctataatatggaaataataatacctacctcatagagttgtgaagattacagttttaataaatacgcaaatcactcagaatagtgcctggcacacagtaaatgctacttaagtgttctgcctaaaggcttgagtcttggcttattttctatccatgtgaagatgtctgctctcaaaagcagattggtccaacactgaattcaagtgttcttttcctaacctgttgtacttcccattttttttttgtctaaaagtaatagcagtacttaataaaatgcccacacttggcatgcatctaataaatgttttttgaatttctagaagtcatttttcttctttcttacaagaaatttattcatttttctatatgccttagctcaaaccaaagagtatttaaaacatcttatgaaaatgcatatagtagagcaagataagattaatgaaaaataggcttaagtgagaccaaaaaaataagggtaaaataaacaaatttaggagtgagcatattctgtgattgtgcatgaagttccagtggctttctaaaggtggactacaaatttggtcactgttgtgaaaaggaaagtagccagctgaaagattcagtatctgtatgctgaaagccgttaagttgctcggactagaaggaaattttcccatggatcctcaaagaggcttgtttaatgtaaaaatcagtagtaacctgacagtgacatggtccaggtactttaggctgtcttatcccttaatgtaggctattaccatcaagcacagttttgcaaatagccagtggaatgtagttcagatacatgactttgtgggtaatccaggggtagagactaaaacagtactgtgcagtatgtggttatttacagttaattaagattaaataaaatttaaaaattagttccttgactaccaaatgctcaatagccactagtaggtaccatgttgaacagtacagatatagaccatttccatcatcacataaagtactgttggattgtgttggtcaagacaatctaaagcaattgtttcccaggtgtgctgtgtggtgtgccttacatgtcattgaaaggggtgctgtcaggagttctagatgcttcagcctccctttactaagagcagttcttatgttttctattttatcgcttgggcttccagatacaatgttttgttttaggtttgttttttttgtttgtttgtttttttttttttgagacggagttttgctctggttgcccaagctggatggagtacggtggtgcgatcgcggctcactgcaacctccgcctcccgggttcgagagattctcctgcctcagcttcccgagtagctggaattacaggcgtccaccaccatgcctgactaattttttttgtatttttagtagacttggggtttcaccatgttggccgggctggtttcaaactcctgacctcaggtgatccacccgcctcggcctcccagagggctgggattacaggtgtgaaccaccgtgcccggcctgttttagttttttagagatggagtctccctctgttgcccaagccagagtgcggtggcatgacactctcagggttcaacctctcagggatcaagggatcctcccacctcagcttcctgagtagctggaaccacaggcacatgtgccaccatgcccagctaatttttgtattttttgtagaagcaaggtttcaccatgttgcccaggctggtctcggactcctaggtcaagtgatcctcccacctcaatctcctagagtgctaagactataggcgggagtcaccatgcccagcttcatctacaatttatttgaagaaaatgtttgagcaccacccatcttgaaaagtgatagactgccttccattaaatactgtcacacctagttatttagcagcagtgagcttcactttttatactttagaccttaatctaaagggtgatttctagttgccagttaaatccagagccaagctctttggagaatccaggagcctcactaggtcatgtatcaggataaaatacccatccactcccattagaaggtgagcttgtacttatggcttcctgatggctgctgcaacaagtctaaagcagtctccttagtatacaatgtcttctctaagtggtagaaaaaagcaaaaatactacaagttaatagggctacataaaatttgctagtttcttttttgccctagccatttattccttcctgaaatcttgtctctctctcgctctctctttctctcgctctcactttctttctctttttcttttctcttttcttttctttcttccctttcttttctttcttttttcctgttgcccaggctggagtgcagtggaacaattatggctcactgcagccttgacctttctggacccaggtgatcctcccacctcagtctcccaattagctgggactacaggcatgcgccaccacacccagctataatatatattgtatatatattttttatttataaatatatataaatatatatttatatgtgtaaattatatatatttatatattataaattatatataaatatatatttatatataatatatataatatatatttatttttatatattttatatatattttttggggggggttgggggggatggagtctcactctgtcgcccaggctagagtgtagtggcgtgatcttggctcactgcaatcttcgcctcccaggttcaagcgattctcctgcctcagcttcccgagtagctgggactataggcgcctgccaccacacctggctaatttttgtatttttagtagagatggggtttcaccatattggccaggctggtcttcaactcctgaccttgtgatctgcccacctcaacctcccaaagtgctgggaatacaggcatgagccactgcacccagcctaatctttgtatttttttgtagagaccgggttttgccatgttgcccaggctaatctcaaactcctgggttcaagcagtctgccctcctcagcctcccaaagtgctgagattgcaggcatgagccactgtacccagcctaatcttgtttttcttatgttctgataatatattcccgtttttagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacaggtatggtacagctttcagcatttgtgcaagagtttgcatcagttgattaactctggtagagatgtgatccatattcatattctttgttgttatgcatttttttcatttttatttttttattttttatttttttttaggcagagtctcactctatcttctaagctggagtgcagtggtgtgatctcagctcactgcagcctctgtctcttgggttcaagtgattctcctgcctcagcctcccaagtagctgggactacgggcacatcatcatgcccggctaatttttgtacttttagtagagacagggttttaccatgttgcccaggctggtctcgaactcctggcctcaagcaatcctcccacctgggcctcccagagtgctgggattacaggtgtgagccaccacgcccagcctgttgttaggcatttttagtagtgttctttttcttaacgcttgtttaaacccaaaatgaacttactaatattctgttatggcatgtttactcctgcattaacatccacaaatatttcttgggaagatccttgactaaaaatatttataaacattagttatttctctgtcaacaccagcccgtttatggcttaagcctcctgaatggagtctttagtttaatgtagttttgttccgtgtttctcacattacccttttcctttgcatgaatgtttatttggcaaaatgtgccatttttatatcagcctgttcttgtgattcaataggaatgtgaaatttagtgttctcttccttaaatcaccatattttattttatcagctattcgtttagtaattggaatcttatgtccacataaagagatacaaatgcaagagagcttataatttggattgtgtccgttgagctagctctctcattttttttcattttttccttttatagggtgttgaagatgctttttacacactggtaagagaaatacgccagtaccgaatgaaaaaactcaacagcagtgatgatgggactcagggttgtatgggattgccatgtgtggtgatgtaacaaggtgagcatatggtttcttggcataattacaaatcttagtatatagtattgggcaatttggaggagtgctggtgttattgtctatatgttttttgagtttctgcctatcctcttctgcacattttccatatgacaccctttctgaaagtactgaggtctaaagtgtttaaaacatttgattattccacaggtatctttatatttttggtaacattagaaattataagacattatttatgaaatgtaggcataccctattcctggcaatgaccaggaatttgaaggatcactactttgaaactagttaataaggacatggtttctgttctttttttacagatacttttaaagttttgtcagaaaagagccactttcaaggtaggacaagtttggaaatgtattctcattcctgttaattttgtatatttgtttttcttatactctgaatgtgtcacttatacaaattctgtttctatttcagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataattcttatattca

SEQ ID NO: 9334 - DNA, 4546 bp, Homo sapiens
acggacatatttattggaatgcatggagctggtctgacccatttacttttccttccagactgggctgctgtatttgaactgtaagtgttgggaggcagttttacactgaagcaactgataatgctttttatgcatgctaaagctttcattctgagcatcaaaaggcttaatatttaatcattcaaaaagagaagtcacatcatatagacaatctggaaagaaaagaggcctgaagctaaaaatacaaagtctgcagcctgccattgcacttagtaagccaactaccccttcatcttcccatcccgagcatgatatggaagatgtgaatctgtggtttccttattctgagtttgttcctgcatacctcccaaactctgagcgtcttcttgcaaacagtgtagttattgtgttaaaagaaagcatttatgtctcatgcacgacatagcttcaaaacacaagccaaccacttaacttagtgcttgctgatcccatacacagggaaactgaggcccttgggtgttcatgatttgcccagggcatacttttaactcagtggttggtttatggagacatgaccttccctctcataataattctgctgttggcactgtgctccattttaggtcttgagacactaatagcagttactgttacctgtttccccccattatgtctaaatatctgggttctatggtttcattttaaaaatgatttgactctgtatttaaataggaggctatttaggaaaaaagttgtcatgaacttccaatgccctgcaaaacatttcaaaaatatatatgatatatgtagagaaatagccagataatggattctatctctgtcatttctcttatagagagagaaggaaggatggaagaaaggagagagaagggagagaaatgtaactgagaaaactcaagccttatagtctaatggacctgggttctacttttgcatccttcactatttagttatatgaccttggaagtgttacctatcccccttgcctctttcatacatttaaagacagaggtattataaggtcatgccaagtccataggcagcaggccctattgaataaggtcaattctctccattccatgaccctattttgttttttaaaagttaagttcatttagttcagagaatatttttacattctcttcctcagtcttgtttactgtcttcctcagtcttgtttacaaccttttgcaaggacatatttgggagctgcattttattttcgcagagttgttgatttggaaaaaaccttggacaaaagcctcatgttgtgacacccttgtgtccttaggtacaactgtgaagatgaacgctgttacttagacttggccaggctgagaggcgttcactacatcacttggcgacggcagaacaaagtctttcctcaggataaggtaaagttcaatcacaaaacttaccttgcttcatttttaattggtttaaagtatccaattattgatatgaaaaatggttattgaacttcagtgctgcaaagataaactgttctctggaatactgaattgttttattttatatttgcaaataggagaaaaaggggaattaagcaacctatatctttaatgttacaaaggcagcttcgtgaaatttgggcttagaaagatctattagattatatatagagacgggatcaacaagcaacagccctgtgggcaaatccagcccatgacatgtttttgtaaagaaagcacagtcatgcctgtctgtttatgcactgtctctagttgtttgtgcacttcaacgacagtggagtaactgtgactgagaccttagagtcagcagagctgaaaatatttatcatctggcccttatcaggaaaagtttgctggtctctgatgtagaacataaattagttgccttaaccaaagtaacataattttcctgctgtagagaaaaccatgccctcattgagttatggattcgtgttttggtttattttcacagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaaccatt

SEQ ID NO: 9335 - DNA, 4546 bp, Homo sapiens
acggacatatttattggaatgcatggagctggtctgacccatttacttttccttccagactgggctgctgtatttgaactgtaagtgttgggaggcagttttacactgaagcaactgataatgctttttatgcatgctaaagctttcattctgagcatcaaaaggcttaatatttaatcattcaaaaagagaagtcacatcatatagacaatctggaaagaaaagaggcctgaagctaaaaatacaaagtctgcagcctgccattgcacttagtaagccaactaccccttcatcttcccatcccgagcatgatatggaagatgtgaatctgtggtttccttattctgagtttgttcctgcatacctcccaaactctgagcgtcttcttgcaaacagtgtagttattgtgttaaaagaaagcatttatgtctcatgcacgacatagcttcaaaacacaagccaaccacttaacttagtgcttgctgatcccatacacagggaaactgaggcccttgggtgttcatgatttgcccagggcatacttttaactcagtggttggtttatggagacatgaccttccctctcataataattctgctgttggcactgtgctccattttaggtcttgagacactaatagcagttactgttacctgtttccccccattatgtctaaatatctgggttctatggtttcattttaaaaatgatttgactctgtatttaaataggaggctatttaggaaaaaagttgtcatgaacttccaatgccctgcaaaacatttcaaaaatatatatgatatatgtagagaaatagccagataatggattctatctctgtcatttctcttatagagagagaaggaaggatggaagaaaggagagagaagggagagaaatgtaactgagaaaactcaagccttatagtctaatggacctgggttctacttttgcatccttcactatttagttatatgaccttggaagtgttacctatcccccttgcctctttcatacatttaaagacagaggtattataaggtcatgccaagtccataggcagcaggccctattgaataaggtcaattctctccattccatgaccctattttgttttttaaaagttaagttcatttagttcagagaatatttttacattctcttcctcagtcttgtttactgtcttcctcagtcttgtttacaaccttttgcaaggacatatttgggagctgcattttattttcgcagagttgttgatttggaaaaaaccttggacaaaagcctcatgttgtgacacccttgtgtccttaggtacaactgtgaagatgaacgctgttacttagacttggccaggctgagaggcgttcactacatcacttggcgacggcagaacaaagtctttcctcaggataaggtaaagttcaatcacaaaacttaccttgcttcatttttaattggtttaaagtatccaattattgatatgaaaaatggttattgaacttcagtgctgcaaagataaactgttctctggaatactgaattgttttattttatatttgcaaataggagaaaaaggggaattaagcaacctatatctttaatgttacaaaggcagcttcgtgaaatttgggcttagaaagatctattagattatatatagagacgggatcaacaagcaacagccctgtgggcaaatccagcccatgacatgtttttgtaaagaaagcacagtcatgcctgtctgtttatgcactgtctctagttgtttgtgcacttcaacgacagtggagtaactgtgactgagaccttagagtcagcagagctgaaaatatttatcatctggcccttatcaggaaaagtttgctggtctctgatgtagaacataaattagttgccttaaccaaagtaacataattttcctgctgtagagaaaaccatgccctcattgagttatggattcgtgttttggtttattttcacagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcaaatggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaaccatt

SEQ ID NO: 9336 - DNA, 10907 bp, Homo sapiens
attcttggtaaattctaaacttcaacttctgttttaaggaaacacaaattcatccagtgttacaaattctgcagcaggtgttgaagatcttaacatcgttcaagtgactgttccaggtatggactaatgttacatttttccttttgtcttaattattttttgacataggctggtctcttggacctgtcatttttcacttagttcaccctgatagctaagaaatgacatttcgggaatataaaatattctgcaagttgctacacaacgagcatcttgctcacatcagacattattaatcggatattttgcttctcctggacaagcccgggcattacctggaaaatgcatctcagagcaggcagcacggagcaccagctatggttgaattggaattggccacagaggtgaaatgttttgttgctcatcattaacaatcttctggccgggcacggtggcttacgcctgtaatcccagcactttgggaggctaagacgggcagatcacgaggtcaggagatcgagaccatcctggataacacggtgaaaccctgtctctactaaaaatacaaaaaaattagccgggtgtggtggcgagcacctgtagtcccagctactcgggaggctgaggctgaagaatggcgtgaacctgggaggtggagcttgcagtgagcggagatcacaccactgcactccagcctgggtgacagagcgagactctgtctcaaaaaaataaataataataataataataatcttcttttctgaatatgtgtatgtaaaatatatctggaaagatacaagagaatctaattacatagttcctccagggaaggaaactgaccgctgagatagggataggagagagacgtttgagatgtttctgtatattactcctcttgaatgttgagccatgtgattgctttagttattcaaaagtaaataaagttttaaagtgttgaaaaatatctaaaaaataaaaacaaaaaaaaaggaccaggcatggtggcatgtgcctgtaatctcagcactttgggaagctgaggcaggaggatcacttgagcccaggagtttgagaccagcctgcacagcacagtgagactctgtctctaaaaaacaaaaagaaaagaaaaacagaccgggtgcggtggctcacacctgtaatcccagcactttgggaggctgaggcaggtggatcacctgaggtcaggagttcgagaccagcctggccaacatggtgaaaccccatctttactaaaaatacaaaaatcagctggtgtggtggtgggtgcctgtaatcccagctacttgggaggctgaggcaggagaattgcttgaacccaggaggggtgcagtgaattgcttgaacccaggagtttgcagtgagccaagattgtaccattgtactccagcctgggtgacaagagcaaaactcagcctcaaaacaaaacaaaacaaaacaaacaaacaaaaaaagagaggaaaaaaaggaaagaaaataaaaatataccttaccttctaatcctagtacctcttattccttttacttgtcatatttcattggctaagatttctattttaaggccgaaaagtggtggtgaaagtaaacatccttgtctttttttttttttttttttttttgagacggagtcttgctctgtcacccaggctggagtgcagtggcgcgatctcggctcactgcaagctccgcctcctgggttcacgccattctcctgcctcagcctcccgagtagctgggactacaggcgcctgccaccatgcccggctaaatttttgtatttttagtagaaacggggtttcaccatgttagccaggatggtctcaatctcctgacctcgtgatccacctgcctcggcctcccaaagtgctgggattacaggcgtgagccaccgcgcctggccctaaacatccttgtcttgtatgatattgaaaatattccttaaaagtagtatgtagtatgtttatatagggttataatttggaaaattctctattgtctgtaatggcttccatttccaaatttccaagatgcttaattattgctaaaagtagactgaataacaatccaggtaaagcactttctcgggtgctaacaggcatttctcccaacagctttcttgggagaaaatacattaataaccttggtttgtttatttgtttaattatttttagataatgagaaggaaagattatcaagcattgaaaagattaaacagctaagagaacaagttaatgacctctttagccgaaaatttggtaagtttttatatctttttatatccagaattcatatacctaaaatacttctttttaaaagaatacttggccaggtgcattggctcatacctgtaatcctagcactttaggaggctaaggctagagaatcacttgagcccaggagtttgagaccagcctgggcagcaaagtgacaccccaggtctacaaaaggaaaaaaacaaaactttatcttataagaatttgatcttggctgggcgcagtggttcacacttttaatcccagcactttgggaggccaaggtgtgtggatcacttgaggccaggagttcaagtccagcctggccaacatggcaaaatcccatctctactaaaaatacaaaaaaattagccgggtgtggtggcgcacacctgtaatcccagctactcaggaggctgaggcacgagaatcggttgtaactgggaggcagaggttgcagtgagcttagatcgcgctattgcactccagcctgggcgacagagtgagaccctgtctcaaaaaaaaaaaaaaaaaaagaaattgatctttttgtgaaagagctatgataaaaattagtcaatatgtctttttacagaagagcttttgcatggtatcattgactaattacaataataataataatagctatctttgttttactgagtgcttaccttgtatattattttttgtgctcaacatgtgtttgatcatttaatcctcacataaaacctttcaggtaggcgccatgataaccctgtgtaatggatggaggaactgagtttgcctactacccatgctaattccaaacttttaaaattatattcacacatcatagtagcactggaaaataaaatgactgatcataagtattgtcatttgatgcttctaaatcctgacattaaagaaaaatcctggtttaggaaacgtaaggaacaaactcagctagttttatttgtgttgttgtttttttaatttgttgttttgttttgtgttttgttttgaggcagggtctcgctctgtctctcaggctggagtgcagtggggcgatctcggctcactgcaacttctgcctcctgggtccctcccatgtggctgggattacaggcatgcgccaccacgcccagctaatttttgtatttttagtagagacagggtttcaccatgttagccaggctggtctcgaactcctggcctcaagtgattcacccgcctcagtctcccagagggctgggattacaggtgtgagccaccgtgcccagccaaactcagctggttttatgctgctcatcccgtcacaggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggtaagtgagtcaaaagaaggaatctggagactctgacttgcccgaggtgggcatgtggctgcccaggaatgtctgtcccatgacttgggctgggggtttgttcccgcagctgaccgctgggccatgctgcctctcacactgacttcatcatcttctgcttccttgagatgtgtccatgtccctgttcctcggtgatcatgggcagcccgtcccagttttagctcacacagcacctagcgtagagttgatactctgcaaaaatttgtccaataaaactaagtggggccaggcacggtggctcacgcctgtaatcccagcactttgggaggctgaggcgggccagatcgcctgaggtcaggagtatgaggcaagcctggccaacatggtgaaaccccgttgctactgaaaatacaaacattagtcgggtgtggtggcgtgcgcctctaataccagctactcaggaggctgaggcgtgagaatcacttaacctgggaggtggaggttgcagtgacctgagatggcaccactgcactccagcctgggcagcagaatgagcctccatctcaaaacataaataaataggccgggcatggtggctcaggcctgtaatcccagcattttaggaggctgaggcaggtggatcatttgaggtcaggagtttgagaccagcctggccaacatggtgaaactccatctctactaaaaataaacattagctgggtgtagtggtacgtgcctgtaatcccagctactcaggagaatcacttgaacctggaatgtggaggttgcagtgagcccagatgacaccactgcactccagcctgggtgatggagtgagactccgtctcaaaaaaaacaaaaacaaaaggctcaacgcagtggctcatgcctgtaatcccagcactttgggaggccaaggtaggtagatctcctgatgtcaggagttcaagagtagcctggccaacatggtgaaactaaaaatacaaaaaattagctgggcgtggtggcgggcacctgtaatcccagctactcaggcggctgaggcaggagaatggcttgaacccaggaggcggaggttgcgctaagccgagatcgcgccactgcactccagcctgggtgacgcggcgagactcttgtctcaaaaaaaacaaaaacaaaacaaacaaataaataaatattcttctgtaaaaaaataaataagtaaaaattaaaaaaaaataaaactaagtgggcaaaagaggaaatgtgagcttgtcacatttatcaatgtgtctttctcttcaggccgcttccagggcttgagctcagtaatggtgagtattctacaggtgagaagaacgttccggcaatgttgggccatgggaagtgtcttggtgggcgctcaccacggggtttttgcttccgtgagcctgggacccaagtatgcagccttcgatgcatgctttatttttcctgcatgtgataaagttagataactctgttacttgagtttgattaaccagtctgaaggagagtgatctatatcacaccatgagtgtgacgtgtgatgtggcgcactcttttttttttttttggagacggagtctcgctctgtcacccaggctagagtgcaatggcacaatctcggctcaccacacaacctccgcctcccgggttcaagtgattctcctgcctcagcctcccgagtagctgggactataggcgtgtgccaccacgcctggctaatttttgtatttttagtagagatggggttttgccatgttggccaggctggtcttgaacttctgacctcaagggatctgcccgcctccaccttccaaagtgctgggattacgggcatgagccaccacgcatggctgatgtggcacactattcaagtgtgctttgtggtgggggctcccctgaggccacccgcacagctgcactcaggatcacagtaccgatctcctctgtgttagttggtaaatagtgcctgcctggccatgcagtcccaccctagtaccctccgaccgtggcttgacctccctacagtgctgaagcaaaaggggttccacctggcacagcagaggcccctagaacccttccagtgctgagactagcatctgttcttttttttttctttttttttttttttgagacagagtctcgctctctcacccaggctggagtgcagtggcaagatctcggctcactgcaacctccgcctcccgggttcaagcgattctctgcctcagccttccgattagctgggattacaggtgcgtgccgccacatccagctactttttgtattttttagtagagacagggtttagccatgttggccaggctggtctcaaactcgtgacctcaagtgatccacccgccttggtctcccaaactgctgggattacagatgtaagccactgcacctggctcagcatctgttctgattgagcaatgcccaggcactctgcttctgaaatattctcttttttttccccttcaacttttattttaagttccagggtccatgtgcaggatgtgcaggtttgttacacaggtaaacgtgtgccatggtggtttgctgcacctatcaacccatcacctaggtattaagcccagcatgcattagctattcttcctgatgctctccctccccccgcccccaccctgttaaatattcttaatgtcttccccggagcccttgcaagtgagtcagtatcctgtcaagtagaatacggagaggtgttctcacgagcatgagtcaccagggaacctcctaatgtaacatttgaaaaccaaagtaggctgggcgcggtgactcacacctgtaatcccagcactttgggaggccgaggcgggcggatcatgaggtcaggagatggagacccttctgtacaacgtggtgaaactccgtctctactagaaatacaaaaattagtcgggcatggtggcgcgtgcctataatcccagctactcgggaggctgaggcaggaaaatcacttgaaccagggagtcgggggttgcagtgagccgagatcgtgccactgcactccagtttggtgacagagcaagactctgtctcaaaaaaaaaaaaaaagaaaagaaaagaaaaccaaagtatcctattaaaatgctccatttttattcccaaacgcatctgattgctaaatgattttttgatcttttataatatctttatttatttattgtattattattggggttttttagagacaaggtctcactctgtcacccaggctggagtgcagtggcatgatcatagctcactgcagcctggaactcctgccctcaggtgattctcccaccttcacctcccgagtaactgggacagcactgccatgcccagataatttttttttttttttttttttgtagagacagggtctcactatgtttcccaggctggccttgagcttctggcttcaagcgatcctcctgcctcagcctcccaaagtgctgggattataggcatgagccgctgtacatggcctacattttcttaaggtgcacttttatgtgtgtgtactctggaaataccttgattacctgcagggtggccaggttctttaaatctaaaacactagcccctgtacactcgaacacacttatacgaatgagttttgtgtggttctgtggccgtcacccttgtcatttgagactcacagtaggtaaaaatcatatgcctttctgtgctcattcccatctctgttattacaaagttttcttgggaatcaaatgagaaaatatattaaaatgctcacacctataatcccaggacttttggaggccaaggcaagaggattgcttgaggccaggagtttgagaccagcctgggcaacatagcaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctctacaaaaaaaaaaaaaaaaagaaaaagaaaaaaagaaaagaaagaaagaaagaaaagatagctcggtgtggtgcatgcctgtagtcccagcaactgggagctgaagtgggaggatcacctgagcccagggagttccaggctgcaatgagtcattatcaccacaaaccaggcactctttcataaaagtcaatcttcaggttttctttagaaaacctgaagatctggctgggtgcagtggctcatgcttgtaatcccagcactttgggaggctgaggtgggcggatcacctgaggtcaggagttcgagaccagcctggacaacatggtgaaatctcatctctactaaaaatacaaaaattagctgggcgtggtggcaggcacctgtcataacagctactcaggaggctgaggcagaagaatcgcttgaacccaggaggcagaagttgcagtgagccgagattgcgccactgcactgcagcctgggcgacagagcaaaactccgtctcaacaacaacgacaacaaaaattcagtcttcaggttttctttagaaaacttgaagatctggccacagctggcatcctggcagcggtttgctggagttgagggtcagccgtccctctgcagggtgggtcaccctcctgttaaccacgccctgccccgccccgcttcctccctctcgtgcgtcatcaagcatttgctgttgttttcctcatagtagtgataagagaaaagtgaaatatctttgtctccctgtctctgtcaaaagtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggctcatcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaaaagcctgaaaaacttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaacttttttttttttcagttttttttccactttgaatcagaaatataatctgcagtatcatacttgtttatattacattgtatgcctcactattcattaaaaatcaagaaagttttattgta

SEQ ID NO: 9337 - DNA, 12718 bp, Homo sapiens
attcttggtaaattctaaacttcaacttctgttttaaggaaacacaaattcatccagtgttacaaattctgcagcaggtgttgaagatcttaacatcgttcaagtgactgttccaggtatggactaatgttacatttttccttttgtcttaattattttttgacataggctggtctcttggacctgtcatttttcacttagttcaccctgatagctaagaaatgacatttcgggaatataaaatattctgcaagttgctacacaacgagcatcttgctcacatcagacattattaatcggatattttgcttctcctggacaagcccgggcattacctggaaaatgcatctcagagcaggcagcacggagcaccagctatggttgaattggaattggccacagaggtgaaatgttttgttgctcatcattaacaatcttctggccgggcacggtggcttacgcctgtaatcccagcactttgggaggctaagatgggcagatcacgaggtcaggagatcgagaccatcctggataacacggtgaaaccctgtctctactaaaaatacaaaaaaattagccgggtgtggtggcgagcacctgtagtcccagctactcgggaggctgaggctgaagaatggcatgaacctgggaggtggagcttgcagtgagcggagatcacaccactgcactccagcctgggcgacagagcgagactctgtctcaaaaaaataaataataataataataataatcttcttttctgaatatgtgtatgtaaaatatatctggaaagatacaagagaatctaattacatagttcctccagggaaggaaactgaccgctgagatagggataggagagagacgtttgagatgtttctgtatattactcctcttgaatgttgagccatgtgattgctttagttattcaaaagtaaataaagttttaaagtgttgaaaaatatctaaaaaataaaaacaaaaaaaaaggaccaggcatggtggcatgtgcctgtaatctcagcactttgggaagctgaggcaggaggatcacttgagcccaggagtttgagaccagcctgcacagcacagtgagactctgtctctaaaaaacaaaaagaaaagaaaaacagaccgggtgcggtggctcacacctgtaatcccagcactttgggaggctgaggcaggtggatcacctgaggtcaggagttcgagaccagcctggccaacatggtgaaaccccatctttactaaaaatacaaaaatcagctggtgtggtggtgggtgcctgtaatcccagctacttgggaggctgaggcaggagaattgcttgaacccaggaggggtgcagtgaattgcttgaacccaggagtttgcagtgagccaagattgtaccattgtactccagcctgggtgacaagagcaaaactcagcctcaaaacaaaacaaaacaaaacaaacaaacaaaaaaagagaggaaaaaaaggaaagaaaataaaaatataccttaccttctaatcctagtacctcttattccttttacttgtcatatttcattggctaagatttctattttaaggccgaaaagtggtggtgaaagtaaacatccttgtctttttttttttttttttttttttgagacggagtcttgctctgtcacccaggctggagtgcagtggcgcgatctcggctcactgcaagctccgcctcctgggttcacgccattctcctgcctcagcctcccgagtagctgggactacaggcgcctgccaccatgcccggctaaatttttgtatttttagtagaaacggggtttcaccgtgttagccaggatggtctcaatctcctgacctcgtgatccacctgcctcggcctcccaaagtgctgggattacaggcgtgagccaccgcgcctggccctaaacatccttgtcttgtatgatattgaaaatattccttaaaagtagtatgtagtatgtttatatagggttataatttggaaaattctctattgtctgtaatggcttccatttccaaatttccaagatgcttaattattgctaaaagtagactgaataacaatccaggtaaagcactttctcgggtgctaacaggcatttctcccaacagctttcttgggagaaaatacattaataaccttggtttgtttatttgtttaattatttttagataatgagaaggaaagattatcaagcattgaaaagattaaacagctaagagaacaagttaatgacctctttagccgaaaatttggtaagtttttatatctttttatatccagaattcatatacctaaaatacttctttttaaaagaatacttggccaggtgcattggctcatacctgtaatcctagcactttaggaggctaaggctagagaatcacttgagcccaggagtttgagaccagcctgggcagcaaagtgacaccccaggtctacaaaaggaaaaaaacaaaactttatcttataagaatttgatcttggctgggcgcagtggttcacacttttaatcccagcactttgggaggccaaggtgtgtggatcacttgaggccaggagttcaagtccagcctggccaacatggcaaaatcccatctctactaaaaatacaaaaaaattagccgggtgtggtggcgcacacctgtaatcccagctactcaggaggctgaggcacgagaatcggttgtaactgggaggcagaggttgcagtgagcttagatcgcgctattgcactccagcctgggcgacagagtgagaccctgtctcaaaaaaaaaaaaaaaaaaagaaattgatctttttgtgaaagagctatgataaaaattagtcaatatgtctttttacagaagagcttttgcatggtatcattgactaattacaataataataataatagctatctttgttttactgagtgcttaccttgtatattattttttgtgctcaacatgtgtttgatcatttaatcctcacataaaacctttcaggtaggcgccatgataaccctgtgtaatggatggaggaactgagtttgcctactacccatgctaattccaaacttttaaaattatattcacacatcatagtagcactggaaaataaaatgactgatcataagtattgtcatttgatgcttctaaatcctgacattaaagataaatcctggtttaggaaacgtaaggaacaaactcagctagttttatttgtgttgttgtttttttaatttgttgttttgttttgtgttttgttttgaggcagggtctcgctctgtctctcaggctggagtgcagtggggcgatctcggctcactgcaacttctgcctcctgggtccctcccatgtggctgggattacaggcatgcgccaccacgcccagctaatttttgtatttttagtagagacagggtttcaccatgttagccaggctggtctcgaactcctggcctcaagtgattcacccgcctcagtctcccagagggctgggattacaggtgtgagccaccgtgcccagccaaactcagctggttttatgctgctcatcccgtcacaggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggtaagtgagtcaagagaaggaatctggagactctgacttgcccgaggtgggcatgtggctgcccaggaatgtctgtcccatgacttgggctgggggtttgttcccgcagctgaccgctgggccatgctgcctctcacactgacttcatcatcttctgcttccttgagatgtgtccatgtccctgttcctcggtgatcatgggcagcccgtcccagttttagctcacacagcacctagcgtagagttgatactctgcaaaaatttgtccaataaaactaagtggggccaggcacggtggctcacgcctgtaatcccagcactttgggaggctgaggcgggccagatcgcctgaggtcaggagtatgaggcaagcctggccaacatggtgaaaccccgttgctactgaaaatacaaacattagtcgggtgtggtggcgtgcgcctctaataccagctactcaggaggctgaggcgtgagaatcacttaacctgggaggtggaggttgcagtgacctgagatggcaccactgcactccagcctgggcagcagaatgagcctccatctcaaaacataaataaataggccgggcatggtggctcaggcctgtaatcccagcattttaggaggctgaggcaggtggatcatttgaggtcaggagtttgagaccagcctggccaacatggtgaaactccatctctactaaaaataaacattagctgggtgtagtggtacgtgcctgtaatcccagctactcaggagaatcacttgaacctggaatgtggaggttgcagtgagcccagatgacaccactgcactccagcctgggtgatggagtgagactccgtctcaaaaaaaacaaaaacaaaaggctcaacgcagtggctcatgcctgtaatcccagcactttgggaggccaaggtaggtagatctcctgatgtcaggagttcaagagtagcctggccaacatggtgaaactaaaaatacaaaaaattagctgggcgtggtggcgggcacctgtaatcccagctactcaggcggctgaggcaggagaatggcttgaacccaggaggcggaggttgcactaagccgagatcgagccactgcactccagcctgggtgacgcggcgagactcttgtctcaaaaaaaacaaaaacaaaacaaacaaataaataaatattcttctgtaaaaaaataaataagtaaaaattaaaaaaaaataaaactaagtgggcaaaagaggaaatgtgagcttgtcacatttatcaatgtgtctttctcttcaggccgcttccagggcttgagctcagtaatggtgagtattctacaggtgagaagaacgttccggcaatgttgggccatgggaagtgtcttggtgggcgctcaccacggggtttttgcttccgtgagcctgggacccaagtatgcagccttcgatgcatgctttatttttcctgcatgtgataaagttagataactctgttacttgagtttgattaaccagtctgaaggagagtgatctatatcacaccatgagtgtgacgtgtgatgtggcgcactcttttttttttttttggagacggagtctcgctctgtcacccaggctagagtgcaatggcacaatctcggctcaccacacaacctccgcctcccgggttcaagtgattctcctgcctcagcctcccgagtagctgggactataggcgtgtgccaccacgcctggctaatttttgtatttttagtagagatggggttttgccatgttggccaggctggtcttgaacttctgacctcaagggatctgcccgcctccaccttccaaagtgctgggattacgggcatgagccaccacgcatggctgatgtggcacactattcaagtgtgctttgtggtgggggctcccctgaggccacccgcacagctgcactcaggatcacagtaccgatctcctctgtgttagttggtaaatagtgcctgcctggccatgcagtcccaccctagtaccctccgaccgtggcttgacctccctacagtgctgaagcaaaaggggttccacctggcacagcagaggcccctagaacccttccagtgctgagactagcatctgttcttttctttttctttttttttttttttgagacagagtctcgctctctcacccaggctggagtgcagtggcaagatctcggctcactgcaacctccgcctcccgggttcaagcgattctctgcctcagccttccgattagctgggattacaggtgcgtgccgccacatccagctactttttgtattttttagtagagacagggtttagccatgttggccaggctggtctcaaactcgtgacctcaagtgatccacccgccttggtctcccaaactgctgggattacagatgtaagccactgcacctggctcagcatctgttctgattgagcaatgcccaggcactctgcttctgaaatattctcttttttttccccttcaacttttattttaagttccagggtccatgtgcaggatgtgcaggtttgttacacaggtaaacgtgtgccatggtggtttgctgcacctatcaacccatcacctaggtattaagcccagcatgcattagctattcttcctgatgctctccctccccccgcccccaccctgttaaatattcttaatgtcttccccggagcccttgcaagtgagtcagtatcctgtcaagtagaatacggagaggtgttctcacgagcatgagtcaccagggaacctcctaatgtaacatttgaaaaccaaagtaggctgggcgcggtgactcacacctgtaatcccagcactttgggaggccgaggcgggcggatcatgaggtcaggagatggagacccttctgtacaacgtggtgaaactccgtctctactagaaatacaaaaattagtcgggcatggtggcgcgtgcctataatcccagctactcgggaggctgaggcaggaaaatcacttgaaccagggagtcgggggttgcagtgagccgagatcgtgccactgcactccagtttggtgacagagcaagactctgtctcaaaaaaaaaaaaaaagaaaagaaaagaaaaccaaagtatcctattaaaatgctccatttttattcccaaacgcatctgattgctaaatgattttttgatcttttataatatctttatttatttattgtattattattggggttttttagagacaaggtctcactctgtcacccaggctggagtgcagtggcatgatcatagctcactgcagcctggaactcctgccctcaggtgattctcccaccttcacctcccgagtaactgggacagcactgccatgcccagataatttttttttttttttttttttttgtagagacagggtctcactatgtttcccaggctggccttgagcttctggcttcaagcgatcctcctgcctcagcctcccaaagtgctgggattataggcatgagccgctgtacatggcctacattttcttaaggtgcacttttatgtgtgtgtactctggaaataccttgattacctgcagggtggccaggttctttaaatctaaaacactagcccctgtacactcgaacacacttatacgaatgagttttgtgtggttctgtggccgtcacccttgtcatttgagactcacagtaggtaaaaatcatatgcctttctgtgctcattcccatctctgttattacaaagttttcttgggaatcaaatgagaaaatatattaaaatgctcacacctataatcccaggacttttggaggccaaggcaagaggattgcttgaggccaggagtttgagaccagcctgggcaacatagcaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatctttttttttttttttttttttttttttttttttttttttccttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttaaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctctacaaaaaaaaaaaaaaaagaaaaagaaaaaaagaaaagaaagaaagaaagaaaagatagctcggtgtggtgcatgcctgtagtcccagcaactgggagctgaagtgggaggatcacctgagcccagggagttccaggctgcaatgagtcattatcaccacaaaccaggcactctttcataaaagtcaatcttcaggttttctttagaaaacctgaagatctggctgggtgcagtggctcatgcctgtaatcccagcactttgggaggctgaggtgggcggatcacctgaggtcaggagttcgagaccagcctggacaacatggtgaaatctcatctctactaaaaatacaaaaattagctgggcgtggtggcaggcacctgtcataacagctactcaggaggctgaggcagaagaatcgcttgaacccaggaggcagaagttgcagtgagccgagattgcgccactgcactgcagcctgggcgacagagcaaaactccgtctcaacaacaacgacaacaaaaattcagtcttcaggttttctttagaaaacttgaagatctggccacagctggcatcctggcagcggtttgctggagttgagggtcagccgtccctctgcagggtgggtcaccctcctgttaaccacgccctgccccgccccgcttcctccctctcgtgcgtcatcaagcatttgctgttgttttcctcatagtagtgataagagaaaagtgaaatatctttgtctccctgtctctgtcaaaagtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggcttgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaacttttttttttttcagttttttttccactttgaatcagaaatataatctgcagtatcatacttgtttatattacattgtatgcctcactattcattaaaaatcaagaaagttttattgta

SEQ ID NO: 9338 - DNA, 10894 bp, Homo sapiens
attcttggtaaattctaaacttcaacttctgttttaaggaaacacaaattcatccagtgttacaaattctgcagcaggtgttgaagatcttaacatcgttcaagtgactgttccaggtatggactaatgttacatttttccttttgtcttaattattttttgacatagggtggtctcttggacctgtcatttttcacttagttcaccctgatagctaagaaatgacattttgggaatataaaatattctgcaagttgctacacaacgagcatcttgctcacatcagacattattaatcggatattttgcttctcctggacaagcccgggcattacctggaaaatgcatctcagagcaggcagcatggagcaccagctatggttgaattggaattggccacagaggtgaaatgttttgttgctcatcattaacaatcttctggccgggcacggtggcttacgcctgtaatcccagcactttgggaggctaagacgggcagatcacgaggtcaggagatcgagaccatcctggataacacggtgaaaccctgtctctactaaaaatacaaaaaaaattagccgggtgtggtggcgagcacctgtagtcccagctactcgggaggctgaggctgaagaatggcgtgaacctgggaggcggagcttgcagtgaacggagatcactccactgcactccagcctgggcgacagagcgagactctgtctcaaaaaaataaataataataataataataatcttcttttctgaatatttgtatgtaaaatatatctggaaagatacaagagaatctaattacatagttcctccagggaaggaaactgaccgctgagatagggataggagagagacgtttgagatgtttctgtatattactcctcttgaatgttgagccatgtgattgctttagttattcaaaagtaaataaagttttaaagtgttgaaaaatatctaaaaaataaaaacaaaaaaaaaggaccaggcatggtggcatgtgcctgtaatctcagcactttgggaagctgaggcaggaggatcacttgagcccaggagtttgagaccagcctgcacagcacagtgagactctgtctctaaaaaacaaaaagaaaagaaaaacagaccgggtgcggtggctcacacctgtaatcccagcactttgggaggctgaggcaggtggatcacctgaggtcaggagttcgagaccagcctggccaacatggtgaaaccccatctttactaaaaatacaaaaatcagctgggtgtggtggtgggtgcctgtaatcccagctacttgggaggctgaggcaggagaattgcttgaacccaggaggggtgcagtgaattgcttgaacccaggagtttgcagtgagccaagattgtaccattgtactccagcctgggtgacaagagcaaaactcagcctcaaaacaaaacaaaacaaaacaaacaaaaaaaaaaagagaggaaaaaaaggaaagaaaataaaaatataccttaccttctaatcctagtacctcttattccttttacttgtcatatttcattggctgagatttctattttaaggccgaaaagtggtggtgaaagtaaacatccttgtcttttttttttttttttttttgagacggagtcttgctctgtcacccaggctggagtgcagtggtgcgatctcggctcactgcaagctccgtctcctgggttcacaccattctcctgcctcagcctcccgagtagctgggactacaggcgcctgccaccatgcccagctaaatttttgtatttttagtggaaacggggtttcaccatgttagccaggatggtctccatctcctgacctcgtgatccacctgcctcggcctcccaaagtgctgggattacaggcgtgagccaccgcgcctggccctaaacatccttgtcttgtatgatattgaaaatattccttaaaagtagtatgtagtatgtttatatagggttataatttggaaaattctctattgtctgtaatggcttccatttccaaatttccaagatgcttaattattgctaaaagtagactgaataacaatccaggtaaagcactttctcgggtgctaacaggcatttctcccaacagctttcttgggagaaaatacattaataaccttggtttgtttatttgtttaattatttttagataatgagaaggaaagattatcaagcattgaaaagattaaacagctaagagaacaagttaatgacctctttagccgaaaatttggtaagtttttatatctttttatatccagaattcatatacctaaaatacttctttttaaaagaatacttggccaggtgcattggctcatacctgtaatcctagcactttaggaggctaaggctagagaatcacttgagcccaggcgtttgagaccagcctgggcagcaaagtgacaccccaggtctacaaaaggaaaaaaaacaaaactttatcttataagaatttgatcttggctgggcgcagtggttcacacttttaatcccagcactttgggaggccaaggtgggtggatcacttgaggccaggagttcaagtccagcctggccaacatggcaaaatcccatctctactaaaaatacaaaaaattagccgggtgtggtggcgcacacctgtaatcccagctactcaggaggctgaggcacgagaattggttgtaactgggaggcagaggttgcagtgagcttagatcgcgctattgcactccagcctgggcgacagagcaagaccctgtctcaaaaaaaaaaaaaaaaaaaagaaattgatctttttgtgaaagagctatgataaaaattagtcaatatgtctttttacagaagagcttttgcatggtatcattgactaattacaataataataataatagctatctttgttttactgagtgcttaccttgtgtattattttttgtgctcaacatgtgtttgatcatttaatccttacataaaacctttcaggtaggcgccatgataaccctgtgtaatggatggagaaactgagtttgcctactacccatgctaattccaaacttttaaaattatattcacacatcatagtagcactggaaaataaaatgactgatcataagtattgtcatttgatgcttctaaatcctgacattaaagataaatcctggtttaggaaatgtaaggaacaaactcagctagttttatttgtgttgttgtttttttaatttgttgttttgttttgtgttgttttgttttgaggcagggtctcgctctgtctctcaggctggagtgcagtggggcgatctcggctcactgcaacttctgcctcctgggtccctcccatgtggctgggattacaggcatgcgccaccacgcccagctaatttttgtatttttagtagagacagggtttcaccatgttagccaggctggtctcgaactcctggcctcaagtgattcacccgcctcagtctcccagagggctgggattacaggtgtgagccaccgtgcccagccaaactcagctggttttatgctgctcatcccgtcacaggtgaagcaattggcgtggatttccctgtgaaagttccctacaggaagatcacattcaaccctggctgtgtggtgattgatggcatgccccgggggtggtattcaaggaccccggctatctggaaatcagttccatgaggaggatcttggaggcagctgagtttatcaaattcacagtcatcaggtaagtgagtcaagagaaggaatctggagactctgacttgcccgaggtgggcatgtggctgcccaggaatgtctgtcccatgacttgggctgggggtttgttcccgcagctgaccgctgggccatgctgcctctcacactgacttcatcatcttctgcttccttgagatgtgtccatgtccctgttcctcggtgatcatgggcagcccgtcccagttttagctcacccagcacctagcgtagagttaacactctgcaaaaatttgtccaataaaactaagtggggccaggcacggtggctcacgcctgtaatcccagcactttgggaggctgaggcgggccagatcgcctgaggtcaggagtatgaggcaagcctggccaacatggtgaaaccccgttgctactgaaaatacaaacattagtcgggtgtggtggcgtgcgcctctaataccagctactcaggaggctgaggcgtgagaatcacttgacctgggaggtggaggttgcagtgacctgagatggcaccactgcactccagcctgggcagcagaatgagcctccatctcaaaacataaataaataggctgggcatggtggctcaggcctgtaatcccagcattttaggaggctgaggcaggtggatcatttgaggtcaggagtttgagaccagcctggccaacatggtgaaactccatctctactaaaaataaacattagctgggtgtagtggtacgtgcctgtaatcccagctactcaggagaatcacttgaacctggaatgcggaggttgcagtgagcccagatgacaccactgcactccagcctgggtgatggagtgagactccgtctcaaaaaaaacaaaaacaaaaggctcaacgcagtggctcatgcctgtaatcccagcactttgggaggccaaggtaggtagatctcctgatgtcaggagttcaagagtagcctggccaacatggtgaaactaaaaatacaaaaaattagctgggcgtggtggcgggcacctgtaatcccagctactcaggcggctgaggcaggagaatggcttgaacccaggaggcggaggttgcgctaagccgagatcgcgccactgcactccagcctgggtgacgcagcgagactcttgtctcaaaaaaaacaaaaacaaaacaaacaaataaataaatattcttctgtaaaaaaataaataagtaaaaattaaaaaaaaataaaactaagtgggcaaaagaggaaacgtgagcttgtcgcatttatcaatgtgtctttctcttcaggccgcttccagggcttgagctcagtaatggtgagtattctacaggtgagaagaacgttccggcaatgttgggccatgggaagtgtcttggtgggcgctcaccacggggtttttgcttccgtgagcctgggacccaagtatgcagccttcgatgcatgctttatttttcctgcatgtgataaagttagataactctgttacttgagtttgattaaccagtctgaaggagagtgatctatatcacaccatgagtgtgacgtgtgatgtggcgcactctttttttttttttttggagacagagtctcgctctgtcacccaggctagagtgcagcacaatctcggctcaccacacaacctccgcctcccaggttcaagtgattctcctgcctcagcctcccgagtagctgggactataggcgtgtgccaccacgcctggctaatttttgtatttttagtagagatggggttttgccatgttggccaggctggtctcgaacttctgacctcaagggatccgcccgcctccacctttcaaagtgctgggattacgggcatgagccaccacgcatggctgatgtggcacactattcaagtgtgctttgtggtgggggctcccctgaggccacccgcacagctgcactcaggatcacagtaccgatctcctctgtgttggtaaatagtgcctgcctggccatgcagtcccaccctagtaccctccgaccgtggcttgacctccctacagtgctgaagcaaaaggagttccacctggcacagcagaggcccctagaacccttccagtgctgagactagcatctgttcttttttttttttgagacagagtctcgctctctcacccaggctggagtgcagtggcaagatctcggctcactgcaacctccgcctcccgggttcaagcgattctctgcctcagccttccgattagctgggattacaggtgcgtgccgccacatccagctactttttgtattttttagtagagacagggtttagccatgttggccaggctggtctcaaactcgtgacctcaagtgatccaccctccttggtctcccaaactgctgggattacagatgtaagccactgcacctggctcagcatctgttctgattgagcaatgcccaggcactctgcttctgaaatattctcttttttttccccttcaacttttattttaagttctagggtccatgttcaggatgtgcaggtttgttacataggtaaatgtgtgccatggtgatttgctgcacctatcaacccatcacctaggtgttaagcccagcatgcattagctattcttcctgatgctctccctccccctacccgcccccaccctgttaaatattcttaatgtcttccccggagcccttgcaagtgagtcagtatcctgtcaagtagaatacggagaggtgttctcacgagcatgagtcaccagggaacctcctaatgtaacatttgaaaaccaaagtaggctgggcgcggtgactcacacctgtaatcccagcactttgggaggccgaggcgggcggatcatgaggtcaggagatggagacccttctgtacaacgtggtgaaactccgtctctactagaaatacaaaaaattagccgggcatggtggcgcgtgcctataatcccagctactcgggaggctgaggcaggaaaatcacttgaaccagggagtcgggggttgcagtgagccgagatcgtgccactgcactccagtttggtgacagagcaagactctgtctcaaaaaaaaaaaaaaaaagaaaagaaaagaaaaccaaagtatcctattaaaatgctccatttttattcccaaacgcatctgattgctaaatgattttttgatcttttataatatctttatttatttattgtattattattggggttttttagagacaaggtctcactctgtcacccaggctggagtgcagtggcatgatcatagctcactgcagcctggaactcctgccctcaggtgattctcccaccttcacctcccgagtagctgggacagcactgccatgcccagataattttttttttttttttgtagagacagggtctcactatgtttcccaggctggccttgagcttctggcttcaagcgatcctcctgcctcagcctcccaaagtgctgggactataggcatgagccgctgtacatggcctacattttcttaaggtgcacttttatgtgtgtgtactctggaaataccttgattacctgcagcgtggccaggttctttaaatctaaaacactagcccctgtacactcgaacacacttatatgaatgagttttgtgtggatctgtggccgtcacccttgtcatttgagactcacagtaggtaaaaatcatatgcctttctgtgctcattcccatctctgttattacaaagttttcttgggaatcaaatgagaaaatatattaaaatgctcacacgtataatcccaggacttttggaggccaaggcaagaggattgcttgaggccaggagtttgagaccagcctgggcaacatagcaagaccccatctctacaaaaaatttaaaaattagctggacacagtggctcacacctgtagccccagctacttggcaggctaaagcaggaggatcacttaaacccaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacagtggctcctataatcccagcactttgggaggccaaggcgggtggatcgcttgagcctggggtttcagaccagcctaggcaacaaggtaagactccagctctacaaaaaaagaaaaaaaaaaaaagaaaaagaaaaaaagaaaagaaagaaagaaagaaaagatagctcagtgtggtgcatgcctgtagtcccagcaactgggagctgaagtgggaggatcacctgagcccagggagttccaggctgcagtgagccattatcaccacaaaccaggcactctttcataaaagtcaatcttcaggttttctttagaaaacctgaagatctggctgggtgcagtggctcatgcctgtaatcccagcactttgggaggctgaggtgggcggatcacctgaggtcaggagttcgagaccagcctggacaacatggtgaaatctcatctctactaaaaatacaaaaattagctgggcgtggtggcaggcacctgtcataacagctactcaggaggctgaggcagaagaatcgcttgaacccaggaggcagaagttgcagtgagccgagattgcgccactgcactgcagcctgggtgacagagcaaaactccgtctcaacaacaacgacaacaaaaattcagtcttcaggttttctttagaaaacttgaagatctggccacagctggcgtcctggcagcggtttgctggagttgatggtcagccgtccctctgcagggtgggtcaccctcctgttaaccacgccctgccccgccccgcttcctccctctcgtgcgtcatcaagcatttgctgttgttttcctcatagtagtgataagagaaaagtgaaatatctttgtctccctgtctctgtcaaaagtgggaaaatgcaagatagaccaggagggccgtgtgtttcaagaaaagtgggagagagcatttttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcaccgatataaataataccacccagttggccatattcatccgtggtgtcatagtgaatttcgatgtgtccgaagaacttctggatacggtgcccacgacgggtacaaaatctggaaacgagatcttttcgcgtgttgagaagagcctgaaaaagttctgtatcgactggtcgaaattagtaagcgtggcctccactggcaccccagcgatggtggatgccaataacgggcttgttacaaaactgaagtccagggtggcgacgttctgcaagggtgcggaactgaagtccatctgttgtataattcatccgaaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacactttgaacatctctctccaaggacactcccaaatcgtcacgcagatgtatgacctgatccgggtgttcctagcaaaactgtgcctctgggagactcacttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacgcggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgcgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcccggctaatttttgtattagtagagatgaggtttcaccatgttggccaggctggtctccaactcctgacctcaggtgatccacctgcctcgacctcacaaagtgctgggattacaggcatgaaccactgtgcccagctgacgaaatgagttcttaaactttttttttttcagttttttttccactttgaatcagaaatataatctgcagtatcatacttgtttatattacattgtatgcctcactattcattaaaaatcaagaaagttttattgta

SEQ ID NO: 9339 - DNA, 509 bp, Homo sapiens
ttaagtcttgcacgttagcactgacccacaactgggcctcaactgtgctgtgttcacgtgaggaaagaatgaagggttgagggtacatgaggggggagaatggaaagaaaaggacgattcactcagacatagcccctttgctactggagtggacagataaatatcaaaggtaactccgcaggcctgcagccggtgaactcagttgaagtgcaagtatctaaaggaagtgaagttgaaagtgtgatttaaggctggcgtggtgggtggctcacacctgtaatcccagcactttgggagacccaggtgggtgaatcccttgaggccaggagttcaagaccagcctggccaacatggcgaaactctgtctctactaaaaatacaaaaattagagccgggcgtggtggctcacgcctgtaatcccagcactttgggaggcccaggtaggtgaatcacttgaggtcaggagttctcaaccagcatgaccaacacggtgaaactccgtctctact

SEQ ID NO: 9340 - DNA, 509 bp, Homo sapiens
ttaagtcttgcacgttagcactgacccacaactgggcctcaactgtgctgtgttcacgtgaggaaagaatgaagggttgagggtacatgaggggggagaatggaaagaaaaggacgattcactcagacatagcccctttgctactggagtggacagataaatatcaaaggtaactccgcaggcctgcagccggtgaactcagttgaagtgcaagtatctaaaggaagtgaagttgaaagtgtgatttaaggctggcgtggtgggtggctcacacctgtaatcccagcactttgggagacccaggtgggtgaatcccttgaggccaggagttcaagaccagcctggccaacatggcgaaactctgtctctactaaaaatacaaaaattagagccgggcgtggtggctcacgcctgtaatcccagcactttgggaggcccaggtaggtgaatcacttgaggtcaggagttctcaaccagcatgaccaacatggtgaaactccgtctctact

SEQ ID NO: 9341 - DNA, 89 bp, Homo sapiens
gctaggatcacaccactgcactccagcctgaatgacagagtaagaacctgtctcaaaaaaaaaaaaagaaaaaaaaaattcagtctggg

SEQ ID NO: 9342 - DNA, 33109 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagtaagtcttatattctattttcttagcttatctttaatttgaaaaagaataatgacacaaacgctttttcctgattagcttttaaaggaagacaatcaagatctaaccggtctgtagttttgccacttaactggttcatcacccaatcagtttccatcccctgcccccatttgtataaaaattactgcgtgtctgcgaaagggcagattactggctcatgcctgtaatcccagcactttgggaggctgaggtgggcggattgcttgagctcacgggttcgagaccaatctgggcaacatggtgagaccctgtgtctactaaaaatacaaaaaatacaaaaaaatagccaggcatgccagtggtcccagctgctcgggaggctgaggtgggaggattgtttgagcccagtgagctgagattgtgccactgcactccaaatgcctgaactatggcacagtttagtatatgttgtattaatagtttagtatatgttgtattattagtatgtatcagtatataggatatctatactatctataatatatagtatatgtaatagtgtatgttgtattaataaatgaagaactccagccctttagaaagtgtagaaccacttgagaaagatcttacttttgtacggcactttacaaagagctgtttatatattgtatccatttagattatttcttaactcccagtgcagctaaaaaattatcttccccattctgttttcctacacaattaaataattttagttccgtaaattgttctttttacaacgctttcttgcattttctctctttcctgtgctttatccaattttgtctttggttcatcatgcccctcaggcatggagtttgaaaactaggtagataggatgtctaaaccaaaaaagtataccatagtattggtcttactcccatacagagaagccattcaaactgtgggaatgaatttgagttattagagaaatgataatagtagtttaagtatgttcattcaggtttacacatatctgttgttaaatttaggatggcccgtactttggaaccactagcaaagaagatctttaaaggagttttggtagccgaacttgtaggcgtttttggagcatattttttgtttagcaagatgcacacaagccaaggtaatcataattcagaagttaatgctttctaaaggggtatagttttgctaatccattttatgtgttaaatggcaatggcatgtttggagaaattggttcttcagattcaagatattagacatttttaggggcagaacaggaatcaaagtattcattattgtggactagatcactctcacttctcccttaaaaatgttgtttgtgggctaaggaaaaaatttcatacctccatggattttactattgtggaggatatagcaagtgtccttggtctggcttagtttgggagcacagatggaggaaacttagcctgcccattatacttcattgtttggtagactaagaaagtaactggtattgctgttttctgagtaaccagttttctcaggctatagtattcttcctgggcatcaacagtgggcactaagactttcacatgctatggccgaaagtgctttaacatttttcttggggaaattttatattagagctctcaactttttaaattaggaagtgatttttccctaaaacagggaatagacctggcatgatagccatctttgaaacttgccacagtcttcctcagcatacttggttggaacgctgtaccaagatgctactggatactcaaaaaatcccttttcttttaaactctaaggaagggtattaaaaaaacatcccaacagtatttaaaaacaaattaaagcttgggatcagttttaaaaagtgtcatggctgggtgtgatggcttgcacttgtaattccagcacttcgggaggccaaggtggaaggactgcttgagctcagtctgggctaaacataacaagacactgtatcttaagaaaaaaaaaaaaagtgctgggcatgatggtgtgctcctgtagtcccagctactcgggaggttgaggtaggaggctcccctgagccccatcccagctacttgaccttggctgacgtaggaggctcgcttgagcccagcccaggggggtctaggcagtggtggattgtgactgtgccactgtactgcagcctgggcaacagggagagagatcctgactcaaaaaaacaaaaggagatcgttcctggattaccagaaagaccttcaaacaaatttctaatctatatggttcccatcatatggaccctaaagctagcattaaattgtggctgtgttaatataatgaatttctgttcatatctaatttcaagacatccttttttccatcagatttcaggcaaacaatgagcaagaaatatcccttcatcttggaaggtatgtttttccttaagtaaaaataagtataaaacaacttcttcaggtaacctataaattatgtagtaatttctttacaaggaatttctaacaatactattcacatgtattttagttcttctgagactaaattctcatctattctagtgagaggagaattaggtaatgggctggattctgaattcttctagtggttaagaatgtaaactctggaatcattcatatatgaggtgatagaatcaaaccacagtttaaacctttggttttaaaagatcagtttcatctcaggtttgctaacttcttggagctgtctctttctctgtcaagtagataaagactgaacaagatgacatcatgtagttagacgaaatagtgctcattacaatgatcagagatgccaggacttatatgtgaagtctgtaatcctactgtcctctttttcattttgttatgtagcaatatggaaaaaagaagttgtttttttcaatacatttaattttaacaatgcttccacatgactttataaatgagagctatttttatttatagtttattacaaatccactgagaagtctggaatgtatggaatcagagagctagatcaaaaaacatggttgaacagcaaaaattagatgtaagtagaattttaatctataatttacattaataactcatttcctttgttttttagttttttgagtggttttaatcctcttctttttaaaatgtttctttttcttgatgatactttttgcatctctgttgtgtagccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaaaaaaaaaaaaaaaaaaaaaaaaaaaaaaaaaaaagaataaataaaataacgaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcattttggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgatttttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttgatctcttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaattccttgcctctttttgtttcagtcaattctgttgggtattctttaatctgcatccaaaactattatcaattgagatctgaaatcctttcaggctaatgtcttctgaaacagtactttactatttgaaacaagctcagagcatcttttttaacattaaaaaatttttttcttctcctcaaattccttttaccagcatcttttaataaaaggctcagtagaacttgaagtaaagcaacacttttctgtgggatgcttttgagaaaaactgcctatatctcatcttatgctaatactaaaacatgatcttagatactcaagggaagacaaaatctggaagataacgtgttataatttaaatatgtatcagttaaatcatagttattacaggactaagaaattgacagcagtatttgaaagagctgataaaattttgtaggcgtgaggctctgaaagactactaccaatatgtaaatgaaactttttgtcaggcctctgagcccaagctaagccatcatatcccctgtgacctgcacgcacacatccagatggtcggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgccaggcagagaacaaccccctttgactgcaattttccttttttctacccaaatcctataaaatggccccacccctatctcccttcactgactctcttttcggactcagcccgcctgcacccaggtgaaataagcagccttgttgctcatgcaaagcctgtttggtggtctcttcatacagacgcgcatgaaactttttaaaacattattattatttaactttgcagatctatttttagtcatcagtatttagcagtaagcagaagccagagaggcactggaggcaaagtatgtacagtgctttctacatttttatcaaaaatcttaagactgtcacctgatacagcacttttttcttttattagcaccttgtgttacactgtgaagcagaatcttgtaagataatacttttaaaaatgttaaaaaacaattagcagaaagaagagttcgtatcataataaaggagcatggattattgcaagggtcaaatggcaaataatggttgagaaaagaaaaagataacaggtgtctgaaaaatgcaaggcttttataattgaatggtttaaaaatgaatgagcagagattagcatgtgaatctctggactaggtaaggaagatctgcattcaaatgtgagtgggcaccatccaatctgctggggccctggagagaacaaaacaaagaggcaaacatgttgatctgctgtgctgaggaggaaaatggcggataaggggacaggactaacgtgcagctcccacatggatggacagaacagcgtgtggcaacgtgtttagtctccttaaaaggtatccaacaaaactaagcttcctaaatgaaggagagatatctatgctgagaattcaccactaccaagccagcactataagaaatgctgaaaggagttctaaatctttgttttttgtttctttttttgagatggaatcttgctctgtcgcccaggcgggaaggcagtggtgtgatcttggctcactgcgacctctgcctaatgggttcaagtgatttttgtacctcagcctcctcagtagctgggattataggggcttaccaacatgcccagctaatttttgtattttttgtagagatagggttttgccatgttggccaggctggtcttgaactcctgacttcaggtgatgcccgcctgggcctcccgaagtgctgggattacaggtgtgagccactacactcagcctaggaattctaaatcttgaaacaaaaccttgaagtacaccaaaatagagccttcttaaaacctaaatcttacagggcctatacaataacacaatgaaaaaacaacaaaatcaaagtattcaagcaacaactagcatgatgaatagaatagtacctcacatctcaaatactacgttggatgtaaatggcctaaatgctcctcttaaaagatacatttggaccaccaaccaagaatctgctgtgttcaggagactcacgtaacacataaggactcacataaacttaaggtaaaggggtgggaaaagatattccatgcaaatggaaaccaaaagcaagcaggactagctattcttatatcagacaaaacagactttaaagcaacaacagttaaaaaagacaaagagggacattacatactagtaaaatgattagtccaacaagaaatgtcataatccaaaatatatatgcacctaccaccagagcttccaaatttataaaaccattactactagacctaagaaattagacagatggcaacacaataatagtgggtgacttcaatactccactgacagccctagacgggtcatcaagacagaaagtcaacaaagaaacaatggacttaaactataccttagaacaaatggacttaacagatacctacggaacattctacccaaaaactgcagaatatacattattttcaccagcacacggagcattctcaaggatagaccatatggtaggccacaaaacaagtctcaataaacttaagaaaactgaaattgtatcaagtaccctctcacaccacagtggaatacaattggaaattaactccaaaaggaaccctcaaaactatatacaaatacatggaaatttaataatctgctcttgaatgatctttgtgtcaacaatgaaatcaagatggaaattaaaattttttgaactgaacaatagtgacacaacccatcaaaacctctgggatacagcaaaagcggcactacatttagtaagttcacagcattaaatgtctacatcaaaaagtctgaaagagcataaacagacaatctaagctcacacctcaaggaactagagaaacaagaacaaatcaaactcaaacccagcagaagaaaagaaataacaaatatcagagcagaactaaataaaactgaagcaaacactacaaaagataaatgaaacaaaaagctggttctgtggaaaaataaagaaaatcggtagaccattagcaagattaaccaaaaaaagaagagagaagatctgaataagctcaattagagacgaaatgggagatactacaaccgataccacagaaatacaaaagatcattcaaggctactatgaacacctttatgcacaaaaactagaaaacctagagaaaaatggataaattcctggaaatatacaacccttctagattaaaccagaaagaaatggaaactctgaacagaccaataacaagtagcacgactgaaacagtaataaaaaaactgccaacaaaacaaagtccaggaccagatggattcacagctgaattctatcagacattcaaagaactggtaccaatcctactgaaactattccaaaagatagggaaagagggaatcctccctaaatcattcaatgaagccaatatcgccctaattccaaaatcaggaaatgacataacaaaagaaaactagagaccaatattcctcatgcacacagatgcaaaaaccctcaacaaaatactagctaaccaactccaacagcatatcaaaaagataatacaccatgatcaagtgggtttcttgccagggatatagggctggtttaacatacgcaagtcaataaatatgatataccacataaacaattaaaaacaaaaatcatatgatcatctcaatagacgcagaaaaagcatttgacaaaatcaagcatcctttatgatttaaaccctcagcaaaactggcatacaagggacgtaccttaaaagtaatgaaagccatctatgataaacccatagccaacattatactgaacagggaaaagttgaaagcattccccctgagaactggaacaagacaaggatgcccactttcaccacttctattcaacatagtactggaaatcctagccagtgcaactggacaagagaaagaaagggcattcaaatcagtaaagaggaagtcaaactgtcactattcaccgatgatatgatagcatacctagaaaaccctaaagactcatccaaaaagatcctagatctgataaataaatccagcaaagtttcaggatacaaaatcaatgtgcgcaaaccagtagcattgctatacaccaacagcaaccaagctgagaatcaaatcaattactctaccccccttacaacacctgccaaaaaaaaaaaaaataataatacttaggaatacacctaatcaaggaggtgaaagatctctaaaaggaaaactacaaaacactgctgaaagaaaccacagacacacacaaatggaaacgcatcccatgttcatggatgggtagaatcgatattgtgaaaatgaccatactgccaaaagcaatctataaatttaatgtaattcccatcaaaatgccatcatcattcttcacagaactaggaaaaaaaatcctgaaattcatatggaacaaaataagagcctgcatagccaagcaagactaaacaaaaagaacaaatctagaggcatctcattacctgacttcaaactatactactaggctattgttaccaaaatagcatggtacttgtacaaaaacaggcacgtagaccaatggaacagaatagagaacccagaaataaagccaaatacttacaaccatctgatctttgacaaagtaaacaaaaacaaagtggggaaaggacaccctattgaaccattggtgctgggataactggcaagccacatgtaggagaattaaactggatcctcatttctcaccttatgcagaaaactcaagatggatcgaagacttaaagataagacctgaaactgtaaaaattctagaatataacattggaaaaactcttctagacattggcttaagtagagttcatgaccaagaacctaaatgcaaatgcaacaaaaacaaatagatgggacttaattaagctaaaaagcgtctgcatagcaaaataaataatcagcagagtaaatagacaacccatagagtgggagaaaatcttcgtaaactatgcatctgagaaaggactaatgtccagaatctataaggaactcaaaaaagtcagcaagaaaaaaacaatcccatcaaaaagtgtgttaaggatatgaacagacaattctcaaaagatatacaaatggtcaagaaacatatgaagaaatgctcaacatccctgattatcagggaaatgcaaatcaaagccacagtgcaataccaccttactcctgcaagaatggccgtaatttaaaaataaaaaaaatttcagatgttggcatggatgtggtaataagggaacacttctacattgctggtgggaatgtaaactagtacaaccactatggtaaacagtatggagagtccttaaagaactgaaagtagaactatcatttgatctagcaatcccaccactgggtactacccagaggaaaataagtcattatataaaaaagacaaacacacagatttatagtagcacaatctgcaattgcaaaaatatggaaccaacctaaatgcccatcaactaatgagtggataaagaaaatgtggtatacatataccatggaatgctactcatccataaaaaggagagaaataatggcattcgcagcaacctgaatacagctggagaccattattctaagcgaagtaattcaggaatggaaaaccaaacattctatgttctcagttataaatgggagctaagcaatgaggatgcaaaggcttaagaatgatataatggactctggggacttggggggaagagtgggaggcagtgggggataagagtacacattgggtgcagtgtactgcttgagtgatgggtgcaccaaaatctcagaaatcactactaaagaacttacctatgtaaccaaacaccctacctgttccccaaaaacaactgaaataatgataacaaatttttaaaaagtgaatgaaaagatgatccagagatatctgaatgcgagaaacaattcaaaatgtggaaaataatttccacttaacatctttcttaaaaagaaccccccccacccctgaattttattaatcaaatttaggagagttcatttcccaaaatgataatgacacctttcacatggacactgcttttaaaagatattaaatgtattttcttaccttgaaatgagccagcaaagtcaaaatcatctgtaccttttctcttgcttttcttagtactgactttggagtggacttcaagttctgttacacgaaaaaatttgctaataagcaatttaaaaacaataagactggaaaatattactccaagatatgctaaaatctttattctgatggtaaggcactatactgctattccatgtgggttttgtaattccactagcataggcttgaggacagactgagaaaaagactctaagaattggcacagttctaatattttgtgcaagtacaaaattttctaaatagcttcattaataagaccaaataatataaaaccccttaaaacaagaaacttctgctgtggttcagaataagtaagaagaatgttgggcaggcatgtgcatgctggaggtatgtgaaaggacagaaaggtcagacaacagtctagagacaattctgggtgttccttgctaatttacaagataaaatattcaccttcatctatgctgggctatgatgaatactgattaacttttataaactgctaattactatcaaaaaatggcagcatttcagctcaacatgtattgtacagagaagctagctgctggttaaagtaaaagtccaaagctcaaaaagctgcttaaaagaaaacacacataacacacaataaaaacccttcagctccaaacgagaagggaaaaggtccttttaagtttctggctgacatgagtattaatttgaatacagggctatattaaaaacctttagcagaaaaacaaacttaaggctaaggaagtgaggaagacacagtttatgtcttattttaaaaaatgcttacctggaacgctctcactttcatcatctaacacatccatgaatgttcctccatcttcatcaacttcagcaaattcttcatcatccatacttcctaaagaaacttcatcgtcatccaggttaccaagttcatcatcactaccttctgaatcttcatctaatgtgttatccttagctccttttgttctctttttcacgtttctggaaaaaaacacaacttgtaatacaagaggaggcagtattttctaaagtagtgttttgctgactactagggcagtaggctattaaatgactcagaaggagaaagctttgcagactgctcagagtaaataataacgtgctttataaatgtcaaagatgaaagtactgtatccacttcccaaacttacttgactacatttcccctttatcatatagttctgtggtctactgttctgagggacaacaatttgggaaatgctagaaaaataggaaggagaagatagaagtatgttacccagcaaaatccatatcatcctttccagagctgaaacagttatcatcttcaaatgtgtctgccagacaatacagaaatgtgagatacaacaaagaatgacaagcttgacatatatcttgtatctgaatcaattattctaagtcatgattctgctgtttatgacaagtgaacaccaaaacaatgtaaatgttactgttgctagtgtgccttaataatgtatacaaacctgtgaaatactgatcttagttaaatcccaaaactaaagaaggatccagttaatttcggctctttctacagttcttttatggaaagaggataaatatcaaataaaatgatatttagcaattgtcgtcctttttactctattagaactacttaagtgctcatttttaataggtgtgatacaatatgtaacatctcatgcttgtaattccagcactttgggaggccgaggtggagtgatcatcagcctgggcaacacggcaagaccctatctctattaaaaaaaaaaaaaaaacaaaaacaacaacaacaaaaaaaaaaacaaaaaaaaaacgagccggacatcatggcatgtacctgtagtcccagctacccgtggggctgaggcaggaaaatcgcctgagcccagaaggtctaggctgcagggctgcagtgagttgggattgtgccactgcactccagcctgggagacagagagagcctgtctcaaaacaaacaaacaaaccccccaaaaaacaacaacaaaaaaatatgtaacgtgaaatcagtgtaagtctttccaatttaccatgttttttgtttaagtctattaagtttcaatcaaaatttctgtagctctgtggattaaagataaaaaagatcaaacagtagactattgctatcaattagtactgatatactataatagattatgaatagtaaaaaggatttctttttcacatgagatttggctgtaacaattgaatagacttaagcaaatataaatgttttcttatatagactatccaaagcacaaatcatgtatttttctggtgcaaatgtgggtgaattaccatatatcataaaaatatttgtttcttttgttttttttttgagacaggatttcactctgtcacccaggctagagtgcagtgccgtaatcttggctcacggcaacctctgactcctggattcaagcgattctcgtgcctctgcttctcgagtagctgggactacaggtgcgtgccaccatgcccagctcattttttggggtttttagtagagacagggtttcaccatattggccaggctggtctcgaactcctgacctcaaacaatcttcctgcctcggcctgccaaagtgctgggattacaggtgtgagccacagcgcctggccccaaatatttcttaatcttccactgtgatttgcatgatattcttagctaagtgattttttaaaactaaggccacttctcccactaatgttccatggtctattaacacatagtagtagattattttacaaagagtcaacaaaacaaattaccaatcagctcttcaaattcttcatcatccacgtcttctatactttcttcatctgcatcccgtttttgtttctctttaacagcaacttttttataatacctataatattcatgttatatatttgacaattttattaaaggtctaatcttactatatatcatcaaagcacctatgaccagtggcaaaccacaactgtaaaatcttaagtatactcaattggaaataaatgactgaaatttgtatctaatatacaaaaaatagtttaactcaataaaaagtagctggaatcttttaagtgtaatacatttcaaagataatattttatcagccctattcttatattagaatacagcaaaacttagccatttacagatgtaatcaaaccctcaaaattattcattctaaatgattttaaaaaacaagccaaatcaaacctaattaaccagtcaaccagatgagataagaggtactttactaccctaaggcattaggttatgatactagttggtttaggacttatttctataacagtgcactgaatccattctaagggccatggtctggataaattacccatgagttatcactatattaaacttaaagtattatattaaaatctatattaaaggtagattttaagcctataaagaaaattattataaaaggaaattaaaggctaaattccaaaaagaagcataaaacaaaatttatatgctaaattaacaaaactcccaaatttactttagttttactaagatatattaagattagcaaaatgacggatttgtaaattttcttaacaaacacagacatatcctttgatcttttcaaaatatgctgattagatttcataaaatgaagcatttaaaactaaggccacttctcccactaatgttccatggtctatttacacacagtagtagattattgaagtagattatttcataaaatgaagcattttatgaaatctaaaaatttaaattttagcagtttccccaaatgaaactatattatgtatagtacctgtggaaaaacacttcatccactggtatttggctttcttcttttgcaaggaactccttactgttcactacaaaaataaatttaaacattttaacttcatatagcaatcccctttatgttactcaagctcttaagacaaaatacagcataatctgtaattctaaaaatctcagaattgtgtgggaaggtagacagaagggactctggagtgcaagggacaatctctgaaaaagtctgtgtgaagacccccccaacatttgaaacttcactggctacagcataaagtaggcagtacatagctgtcagtgccgttacagtgaaacaacagggttctcttactgttcttcatttgcatccaggacccaactttcaagagaaataaaaaattcaaagagttattttaataaataatcactttaaacttgtcattttcagctcaaaaaatgacaagcttgccattaatgcgtgccattctgggaataaacaggaagttaacagagttttcctttatactgaggaaaactaagaaataaggaactacaagaaatcagttttacctcttcagaataaaaattgctgactcatcctgagtaaaaggagatttggcttttaattctaacttactaactgtgggtaagtccttttacatctctggacctctgtgaagtaagtcactggaaattaaatgatctataaggtctaatttaatcctggtctctgaacaaaagggagatgagatctggtatgcaaagaaatgtctgctttgaatacaacaacagactcagatccagaagatggctagcaaatatagaagtaggttattaagtttaaaatgatgctctgtgacaaaaccagctgtgggtttttgtgctgctaagctgatattagagagctttaagatggtctgaattgtaagcaataataattatatacataggggttgtggatgaagctacggatgataaaatggtgacaactgtcaaagctgggtgatggtaatggggagggggttcatcatactattttgtttattttggatatgtttcaaatttgctgtaataaagttaaaaaaaaaaaaaaaaaggcccagtcagatacagtagatttaagaatacctattcttgggaaaaaagatggataatgtctttgatgctcaggttttattctgataaattagaacaaagaataatacaatttatgcatctttgtcttatattgtcttttcagtttcaactgtctaaggtttatacttaccaggaagatgacgaatatccttaataaaatgttttcttttcggctgcatcacaacactatctgtgttttctgaaatgtaaaattatgacagtataatgcaaaacctagttataagctcatattgtttattatgtattaaaaatgaaagccaaataattcactaaatagaagcatacctttgcctttatggggctttggatttcggtatacaaatcgatccaaaaatctcattagagtgaaatcctgcagtgggtcccctgaatactgaatatagtttccctgaaaagtggagcggggatttaaaaacttaattcaaattatgtctatgaatccaagtaagaaaaaggaagaaaaagataatttctattacactgtattgaagatacaaatatgcaataaatgactcttcaaatatctctctcatgcacattatacttaaaaaattaaacacacagatacatatacatacatattctaggatgtaatgttgatttgatggatagactaatattaataatgcaggccatctaaccattaatcaggaaccaaaccctgaagtggcaaacacagcaaatgggaaagtgaggcagtatttctccaggagaggagctagaaggtaataaataaataactgcgtggctttcaatgtcttattgcttccactcatctcagagtgggaaaagttatctgctactctgtatgaaacaagtcactgcttctttatacgagcagtaaaatgtacaagattctctctgttagagaaaacactgtatgaccaattattgattatctaaaatgatactttttttcttatttctcatctttggatttattttagactcacctgaaggatggtctttgcaaaaagggccacggagggatgaaaatgcacagataactaaaaagaaaaatgtgaataatatcaatatttctaaggtcgactcttagtacatttatagcttatttaagaaaatcgggctgggtgtggtggctcacacctgtaattccagcactttgggaggctcaggcaggcagattgcttgagcccagaagttgagactggcctgggcaatatggcgaaaccccatgtctacaaaaagtacaaaaatagtcagggtgtgatggtgcgcgcgtgcctgtactcccagctactcaggaggctaaagtgggaggactgcctgggcccaggaggtcgaggctgcagtgagctgacatggcaccactgcactccagcctgggtgacagagtgagaccctatttcaacaacaacaaaaatgaaaatgcaaaaatttgaaatttaagccaatacattaaaaaagtgattctcaaaacatattggtctcaggaccatttcctacacttaaaaaccaaaaattccatcagtttctattcaacaggtttatatctacagacacctatgttataaaaataaacagaaaaattgtaaatacttataggtccattaaaaataacaataaagcggccaggcgcggtggctcatgcctgtaatcccagcaccttgggaggctgaggtgggcggatcacgaggtcaggagatcgagaccatcctggctaacatggtgaaaccccatctctactaaaaatacaaaaaattagccgggcgtggtggcgggtgcctgtagtcccagctactcgggaggctgaggcaggagaatggtgtgaacctgggaggcggaacttggagtgagccgagatcgcgccactgcactctggcctaggcaacagagcaagactctgtctcaaaaaaaaaaaacaaaaaacaaaaacaaaaaccataaagctactacatactagtaagtagcatatttatgaaaaataattatgcagccaggcgaggtggctcatgcctgtaatcccagcattttgggaggccgaggcgggcggatcacgaggtcaggagatcgagaccatcctggctaacacggtgaaaccccgtctctactaaaaatacaaaaaattagccaggcgtggcggtgtgcgcctgtagtctcagctactcgggaggctgaggcaggaggatggtgtgaacccgggaggcggagcttgcagtgagctgagatcgcaccaccgcactccagcctgggcgacagagcaagactctgcctcaaaaaaaaaaagaaaaaagaaaaaaagaaaaataattatgcttcaggacgaaatatatagcgagtagtattactttacagttttgcaaatctctttaatgtctggcttaacagaagagagtggattatttcatctgcttctgtattccacgttgaaacatacaatctggcctcatgtgtagaaaatagtctttcacatagctgtgaattttcttctttagtactataccaaaaccaaagattagttgtaatatggaatctgaaacccatattcaattggcttttggtacttgctacttaaaattatttggtctactttgaatcaatcatttattcactcaagaatttgtaacattcaggtggcacagtggctcatgcctgtaatcccagcactttgggaggctgaggtaggtggatcacctgaagtcaggagttcgagaccagcctggacaacatggcaaaacactgtctgtgctaaaaataaaaaaattagctgggcatggtggcatgctcctgtaatcccagctactcaggaggtagaggttgcagtgagccgagatcgcgccactgcattccagtatgggtgacagaaccttctcgtttcaaaaaaaagaatttgtaacattgtgcattggtcattggaaaaataccatatgcagtccttccaaacactggcacatttcgttatactttaccacaacaatcacattgttagaaccactgatttcatcagaaaagttttacaaattgagaaactgtcaagctcaaggtggtggttacaagatttttaaaactttaatctttgctcgaaagctttatttttgaattttattgctgacaacaaatactgccagcttttttgtttcattcattttcaagaaaatatctcccaaatacctaagcctgaataaccagtttgtcagtctttcatgaaagagcagctagatgagcttgcaacaactggtaagcacttgtccttgagacacgtgacaaccttcatgctttaggtaggcagcacaggtatgttacgcatacttgctatgtatgcacacgaaatactaaaaagacatgttactttaaggtcaagacactaaaatcagtaattctccctgtgtcatcattcttaagtcatactggcttttttttttttaactgcacatatgtggcagtgatgaatataatggcttctgatgcagcttggtgctgtctttattcaggataagctgcagcagttttacctatcatttcttttatagtatcagtgccaccgtcaacacagtgatgaaaacaaataatgtactggtattactatggaaagagctgtgacctggccgactcactaaaaaggtatcaggaactcttagtggtctggccgcactttgagaatagctgcataagatacttactggctttacacaaaaagtcacagaaaggttattaaaaatatgaattcctcttacaaattcagaaaagtaactttacttgcaaaaaattttatcataaaacttttcagaggtatctaataaataaagcaaaatttatccattttctcaactctatatgcaataatctacctacaaaaagcaacagtcataacccatgcatgacatccttattttacgtgcacacttaagattttctacaaaatgaacacttcacatagtatcttcccccaaatgtggacttttaatgtttattaatgcttataattatcataaaaaaacaaaaacttcaaggcattacatcctcaagggcaaaaatatacagcataggccgggcgcagtggctcatgcctgtaatcccagcactttgggaggctgaggcaggcggatcacaaggtcaggagatcaagaccatcctggccaacatggtgaaaccccgtctctactaaaaatacaaaaattagctgggcgtggtggtgggcgcctgtaatcccagctacttgggaggctgagccaggagaatggcttgaacccggaaggcggacgttacagtgagccacaatcatgccactgcactccagcctggtgacagaggaagactctgtctcaaaaaaaaaaaaaatatatatatatatatatagcataaatgaataaaagacaatttgaaattattttacctttttgagttcccaaagacttgtattttcagctccacagaacagagggtttctactgaatggatcgtatttatttaactgtttcccacctaggaataacaaaaaaaatacgatttctcaaatgctttcttcctagcccaagaggtcattaaaagcaccaccattaatattctcaacagatatctccaacattcttacttagccaagcaacctagattaaaaactctgagctccctcaagaatttgtcttggtacttaagctagcatctgctcttgaataaagcagagaacatgtttatcccaaacaccaaaagctttcttcaaggccaggtgcagtggctcacacctgtaatcacagcacttagggaggctgaggcgagtggatcatttgagttcaggagttcgagaccagcctgggcaaaatggtgaaaccccatctcttacaaaaaatacaacaaaaaaactagccaggtgtggtggtgtgtgcctgtagtcccagctattcgggagactgaggtgggaggatcacttgagcccaggagatgggagttgcagtgaaccaagatcgtgccattgtgatccagccttcctgacagagcaagaccctgactcaaaaataagtaagtaaaagctcccttcaaaacttctcctttggctgggcacaatggctcatgcctataatcccagcactttgggaggccaaggtggaaaggctgcttgagaccaagagctcgagaccagccggtgcacagagtgggatttcgtctctacaaaaaacacaactagccatacctggtggcacgagcctgtagtcccggctacctgggaggctgaggtgggaggatcgcttgagttcaggagtttgaggctgcagtgagccataatggcccactgtactccagcctggcctgggtgacatagtgagaccctgtctcaaaaaaaacaaaaaccaaaccaaaaaaccccaaacttctccctttcctaaatggcaacaaaaggtgcccattttggggccaaagaggtggaaacgttaagatggaaataatctgaagatgaactaggtctaaagtcttttggagctttagagtgcttcaaatatttgtcatgaaagtatgcccagaaataattctcacttggaacaggtctgacattatcttcatgtttttagaaactcaggattaaaaaaatttaaaacaaagatttttcagaacaaactaggaactgactaccttccaacacacaagctcttcatccttctaaaggattattctcagtttagtcttcaggggaactgatggattcttctcaaacttttctggcagctatcagacttctcttttgtacttcacaaactgaaatttgtagatgaattaatttgactgtgagtcccaaagcaagctgaagaaatgggtctggcaccacatttctcgaacctcaaggctggtgttttcttcacagcctcaaatgaaggggctgcatttctaagatttttttttgactctaacattctattaatagacttttaatttagtttggtgtgtgtatagaaaaccacttaacgtttctatcttgaacagaaagttttctatccctaaaacattactttaagaaactgtgggccaggtacagtggctcacgcctgtaatcccagcactttgggaggctgaggcaggcagatcacctgaggtcaggagtttgagaccagcctggcgaacatggtgaaactccacctctactaaaaatacaaaaattagccaggtgtggtggcacatgcctgtaatcccagctacttgggaggttgaggcaggagaatcacttgaacctgggaggcggaggttgcagtgagccgagatcacgcctctgcattccagcctgggcaacagagtgagactctgtctaaataaataaataagtaaataaaatggtagaatgctattttctatgaaaatcaaagagaaacaaactccctagagaataaagatgaaaaaaactcacctttcaaattatcaaagtgcacccaggaagcaacctctggttttttggtttctacatcagtttcaggaactgtttcctctgtctcaagttttttcactatctctgtttctttgtctgcatcagtgaatttttccatgtcttcatcatcatttgcatcaataaaattttcttcatcatcagactcctaacaaaagtatagtttcataaatctacataaatcaactggaagttgcaataaagtctgtgctccattatgtgatgcagagttttacttattgcaactctggtgaaacgtgaaagttctaataaagtaaaatgatggctatcaatggtatttaaacaagagaggagattacatccttatttctaaacataacacagttaagttttgagctaagaacccctgagccttaaggactctaatacttgaaaacaattagccctcaagtaaatttctgacttgtaaataaccctatgaggtaggtactattatttccatttcattgttaaggaagaagacttaagaggtctactaagttttatagtcttccaaatctcatataatggtagcttctagtatagtacagtttattgcaagtagaagagttgagcaacatgcccacctagtaaactgtacagctggtactaaaatctaggtttgtcctattccagaactcacactcatatgctccagagaactaggttactgtcatttgaagcaaagaaaaacaaaacaaaaaccaatatatttcagcacccactcaatttaaaaagcagttgtaaaatataccggatgatcatctagttggcttcttaaacctggttttgctttaaggatctcagacacaagatataaagctccacatataaatggtggcatctgttgacaagtaacttgaagtaacctcttcacaaaagccttcacccggcgcaacacaatgtcagctttcagagatttgtagacaaggttaagaaacatagcttgcttggaacacgtcatcaaccctggatccaacatcttcctgcaaaacaaaaccaaggtcaaatatttatgtataaaaccatctccacaaccaatggtcacatattagaaatagctactaacctcatcttagttagggataactttgctgcttattttagaacaagagaccctgccctaagaggtaagatggaagtcaatgaccagaaaaggatgatgatggcaccaggaaaaaccaacagcaacagacacaggaataggcatttttgagtgtgtggttttcttgtcttttccaagtgtttttctgttttctatatcaacagggcacagccctaacagtatttacagaaccccaccagaaaagctaatctaaaaccagatagtgaaaactgacccatgaaagcagaacattagaagatttgggtttttgtccttgtataactacctactagcagggggaccagaggccgcctcttcatgattttagtgaagaccatcgatgaacagcagaaaattaaattctaaggacttcagagaatctctagtccaatgtactagctgtgtaacattcctctcatacacgctattttcactgcccagagtgcttctctccaactctctgcatgtccacagtatccaaaattggttcttctattagtctctcagtcccatgtttgtgttcttcatagtttcacaaacttgattttcctgcctttccctcttctctaaaggtccaatgaaatagggattatgcctgttattcactgttgtaaccccagtgcctggcagttaatacctttacatgacagttttccaaatacttgaacctatttagctattatgtgcttgtctctccctaatgtctgtcttctgtaggctgctctactttgatctcatgatactttaaaaattctctatcctaggtgctgaatcctacacatgtccccaaccggtctagacctgcagatattaggacacccagaattaacacaatcctccagattagctctattaacacctggaatcattacttcctttgttttaagcatttccattaattttttcctactaacactagaaatgaaaaatacttaagcttgtgaagcactttcctattgctctgaatactctgggaaatatcacccttttggtaatattctgggatattctggattattcaattttctctctttacatttaaattttccctctttacatttaaattttccaacatttccatccattttgcaatttattattaggcataaattacatctcacatcaacagaaacatctgagaagaatttagagacatgtctctatcatttcatgaaatattttcctaatgttttgataaatatttttgtaaaccaaatcatgtcatttcttttatccctcaattaactaggggttttcttaatgtgaaggattcctaataaaaccaagagcaaacaaacactttaagaaggcctaaaggcctgttaagaaactccatctgtgagcgcttttggcaaatagtaatttcaaaaacttaaaaatccacccttcctcagagatgttagactatgatgttaaatagagacagaaaaatgttttctaatagatttcaaacactttctaaaaatcaaaaattcctatgaccatcaaaagttcaaaataatgaaaccaccccccttcaaaacaaacaaacaaacaaacaaacaaacaaactaacaaaaacaaaactcaagatcccgaaacctctacattttcagccttggaactcttttcaaattaacagtgttaagttatctattacttcaaagagttgtggaaaggcttctgagtctttttagtggaccagagcaatcagtgctatgaaatgtcatgaaatctacagcaagtggacctggacttgccacctaacttggtctcttaatatctgtgtgaccttgcccaaattattgtatctcacagtgtggggaaaaggaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtccactcagagttgaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgtgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacaccgacagatgatcaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacatcacagactggagagctgttaagaggattaaactaaagaaacatggatgactatcagtaataaggatagccgccaacatttcacatagcactaagtgttaggcactgttaagcacttaatatacatagaaagattacatgggttaacacacataacctcccaaccttcattaaagccccagttctgtcatttacaagctgtagaaccttgtgcaagtttcaaaatcttcataataatcatatgagatagctgcttttctctccatcctacagacaaatccacttaagcatgataacatgggatgaattatgtctaccaataggtttttagtggggatcaagtaatttgcccaaaattacacagaaaactaatggcagggactcaaacccaggcggcgtggcttaagtctaagatacgaaccactactccacattttctcacaagatatatctatgtaaaaatataaaaatgaatcagaaggaaatatattaatttcttgaacacagttgctatgttcgactgtctcttaaacagctccaaactgtttacacattgctgaaaatatgatgcctcaatgggtgagttgcaaaattcagtaaagaaaatcttcatctccattaaaaaacaacaacaaaaaaaaccctgcaccctgcatcccccaaaactctctacttaacatactttgtttaccaccgctcccctctctgccacctcctccaatatgaatgtgagcgcctccaggggtgggatttctgttcgctgtgcctcctgtgcacctagagcatggcaccatactgcaggcactcagaaaatacttgttgaatgagttactgtgtgaatgcattcaactgtgtgaaagacagcagggaaaagatagaggactgaggagaatgggaagacggaaactgcaattatatctgcaattttatttctttaatatcccaaaagatttaaaacaaatatagcaaaatgttaattctgaaatactaggtggtagatatgaatgaatcttttgggtatttttctgtattttacaacctctcaaaatgaaaaatgtattcaaagcatctaatataatttgtgcccatcagggaaacaaagattaagtgacttacttgaaggtggcgagtagcaagctgctgagggggcctaaaaccaaattttctaactctttttcttgccccacagagggcactgcttgtgctgtactacatcaagttattatttcatgtctcatattggaagggtatgttcttacctgtataatgctgtgtaatatcgatccgatattgtctgctgagaattcattacttggaaaagcaacattaaagcctggacactggtattaaaattcacaatatgcaacactttaaacagtgtgtcaatctgctcccttactttgtcatcaccagtctgggaataagggtatgccctattcacacctgttaaaagggcgctaagcatttttgattcaacatctttttttttgacacaagtccgaaaaaagcaaaagtaaacagttattaatttgttagccaattcactttcttcatgggacagagccatttgatttaaaaagcaaattgcataatattgagctttggagctgatatttgagcggaagagtagcctttctacttcaccagacacaactcctttcatattgggatgtttacaaagtaatgtctctaacagatgggatgcttttgtggcaattctgttctgaggatctcccagtttatttaccacttgcacaagaagagccttttcttcctcaggcttgttacaaagcagctcatgagccacggtaagggctcgagttttagtggttactaatgtatcatgacttaaagtttctaagacctgcacaaattcagccactaagtgtttcagctggtgttcaaaataccataatatcagtcttctatctcttgagtccttgttgccactggacaactgttccagtttgtcaaaaggacgctggctgaaaatcctcagcttccgattgtctggcaaaaggtctgtgataagcaactctttgaaagtatccaaggccataaggcactgctgtttgctgcccttctttttaacaaggttcacaagagtttctacaaactgaagtgtgtgaacggcatcatcctgaataagaagaatcatggctgccatcctgtcacctagtgtccccgatgacacaattgccttcatccaggtagaagaggctcccttttgactattcgtcttacttttgaataagttgatttcatgctgatacagcttctgagcaagggttttgtacttagatacaacatcctgaggctggggtttcaaagaatattcattgctgtactccagatcataccatttgcctccaggcctaagtaacaaagtctgtctctcaaaaaattcaaagatgttctgtttatctttctttactttcggtgtggtactgccattctcatcagaatgtggttctggcctattcttatttttcaccttattaactgatgtcctttgactttctgctgtatttttattatttattttaggtatttttacttcttttttgctggaattttctttttcagctggttcatcttcttcaactaaggaagcttttgtatacttcgccaaattaagattttgaataaatgcttccaattcaccttgctgaaggtcatcgattgctccttttttgcctccatctatcacttcctcattctcatccaaagtagccagcataaggtaatcttgctgcattaaaaacataagttaaaaatacattacaaatgtgaaaaataaaaccataaaataataggaaacacaacataattttaaaaataatttcggaactggaaaaatcctttcaaatttgacataaaactcagggtccacaaaggaaaggataagtaaatttctctttctctctctttcttttacacacacacacacgcacacacactttttatttcgatataggaaaaaaatataaattataaactggaaaaaaaatacaagcaattcctatcaaagtaattgggtttaatcccttaatataagtttctacacatcagtaagtgacaacccaaaagaaaaatgtgcaaaggacatgaacagttcatagaaaaaaagggttctttaagaatatgaaaagatgttcaacctcactgaggtttagacaaatccacattaaaaccacaatgatacatccatcttttaatttatcagatgagcaaagatacactgcaagatgagcaagatacaatgacaggtgatgctggggaaggggtggcggaaacggcactttcatacatggttgatgtgagtgtaaactgacacaacctccatggaggacaatttgtcaactccaatcacaactatttaatacaaggcacacatctgttggcccagcagcttcatttctaaaaattaactaactgattgagacatggtctcgctctgttgtccaggcttgagtacagtggcatgaccatggctgaactgcagcctcaacctcccaggctgaagtgatcctccaacctcagcctgtagctggcactacacgcccagctatttaaaaaaaaaatttttttttgagatgaggtctccttatgttgcccaggctggtctcaaactcctggactcaaggtatcctcccacctctgactcccaaagtgctgggattatgggtgtgagccactgtgcctggctcatttctacaaatttatactacatatacacttacaaaagtgggggaaaaacacgattaaggttattaactgtagtattatttaaaatagtgaaagactggcaataatttaaatattcacaataaatggctggttagataaattaagacagacaaaatgatttatgcagccatagcaatgacacagaacgttatgcactgatatagaaggatttctaagacagaaaagaaagcaaaatgtagagataggtgtatatatatggtaccatttatgtaaaaaagatacacccgtatttcatacacataaatgagtatgtatatgcttgaaaaggtatatagtatccctgaaagatataaaatgcagttgtaaaaataattgcttcctatcagggcaatggttatggctgagataaaagtggaaacaatttgacttcactatgtatcttttaaagtttgcaccacgtgtttcatgtgtatatattacctattcaaaacttaaatatacacaagcacagagcaaactgtgaatctgcctatctctaactaactcctccaccttgaaagtccagtctccaaacaaaataatattaaaaacaaagttaatttctgttccttatctgcttaaaatcttccagtggttttgcatcaaactcagagcaaaagcctgccctctgacccctcggccctcctttcttactattctccccttaactcactctgcctctgctacactggcattttggctgctcatggaataggttaggcactcttctgcctgtctttgcatttgctgttccaactgactggaatggcagctcactccttcctgtcctttaggattctgctcaaacatttccgtgatgtgtttgtcgatcatctcatttaatactaacgcgctcccactccttatcgtccttccttgttttattttcttttatagcactaccccgcgtctgctgtactatgtgtttaaaagtttgtttactgtttctctcccttaattaggatgctccaaaaaagagggcttctggggcatacagtgacacgtgcatgtactctatgagaacagaaatgaaaattccaataccactggtgttcaaaacactcataccacaaggtcaggaccaagaaaagccactctccgacctgatggtgtgatggttataccacgtcaataaaatcagaagatcgcctacatcctaagaatagccagagaatacaacgttcaattcgaaacttttcttttgtaaacagcagtggaaaccggcgtgggaagcgcaccgaacacatgcttcagaggctgggatctcggtcctggacgcccgcgctctacgcagcgcggaagcggcggggcagtcagcctagccaccttcggaactctccacgcctgatcccgttccccggagcccgcggccgttaccttggtgcctccgagccgtaacacttcctccagggagaacccattctcggcttcactagtattatcctcatcctcctcgtccggatcttctactgcctcctcggggcgccaaggccgcttggcatggaactccaaaggctccttgactgcggccatggcgggcaaagcatacgcgcgtgaaactc

SEQ ID NO: 9343 - DNA, 10500 bp, Homo sapiens
agctagcctgcgaatttcagcatgagtgtactgctgaggtcaggtttggggccgttgtgtgccgtggcgcgcgcaggtaagcgtcagtcccctcgaagcccggttgccgtggaagccgcgtggggcgccttcctcagctcttcagttgagggtaccgggggatcaagggctcgggggctcacttccaccttgaaggtaccctgggctggaaacgggtccggtacaaacgcaatagggctgcgtagtcgtgggcaagtgggtgctgtctctgcgccccgtgggcgtgctaagcacagtagcccgcggtctgcggtggggcgaggttaagggttcacgaagctgttttgaaaacgctcaggcggcttgcgctcgtgaatggtcagatttatcatggggtctgtttaatttgtgtttttcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaaggtatgggtcgggtagcccgaggactaggccctctctagccgatttgcgaggtgcaagccaggagggagaagcccgaaggttctcagcccaggcagtgggggtgcctgccaggggaagagccatttctgaggacctggggacagataatttgtcagttggtcagggctggctcacgtcagaggcagtgccagtaaagaggagaggacacggtccaagggtgtttaggagacagaatgtagctgattggatttatgatgcgggaaggatgactttcctacttggctgatggtgggtggtgtggattcattgctttgggagaaggaatacgggaggaaggatggagagttcaggctggtatatgaatttgaagtgtgtgggactcttaggtagaaatctccaacaggcagctggaaataggaattactgcctggaaagtcgtctgtgttggaatggcttcagctggcattggagacatgtgctgggttttctcacatgtgcagttgagaatgcagtctgggtcgtcttcactgttctaggattaggcacagtcacagctttctgacccacgtttccttgtctgttctacagagccatttggtgaaagcctatagtcctttattttagaatatttcatcttttgctgggttgaaatatgacctctgtggaattctggggttagattggccattgttgttggatatggtagtgtgactctagtgtcgaggtttacccaaggccggtatctttctttcgatgccggttaggcagggctgcaagataggtggcttagactagtgtggtggtactagaaatagaagagggtgatttagaaagggactgacaggatttgccgatggattgagtgatggaacggaggaatcaaggctgattcgtacttttagcttgagcagttgggtgatgatggtaccttttattgagattaagacagacaggaccaggtttggaggagtactagggagagggcctacaccaggagctgcattttatacatattttgttagcagtgacatgcaggtggagatagaaagtaggcaattcgctgtaagagtctggcgttcagggccggacgtggcggctcacgcctgtaatcccagcactttgggaggccaaggcgggtggatcacgaggtcaggagtttgagaccagcctgaccaacttggtgaaaccccgtctctattaaaaatacaaaaattagccgggcgtggtggcttgtgcctgtaatcccagctagtcaggaggcaggagaatcgcttgaacccgggacgcagaggttgcagtgagcctagatttcgccattgcactccagcctgggcaacagagcgagactctgtctcaaaaaaaaaaaaaaaaaaagtgagcctggtgttcagaagaaagactgggcaggcatatatacatttgctcgtcatcagcatataggtcatatttaaagccaaggaaccagggagaacatactgagagaaaggaaggtttcccagcattgagagtaggggtaactctaaaatgtagaggctcttaacctagggaccctttaatagaaatcaggggtttcatgaagctggatggaaaaaatattatacctttattttcactaactttcaactgaaatttagcatttcttcaattatgaacatacgcagcaactagtagcatcagcaatacctgtgactttgtcatctgtggaaatcattggtatttccttatcacaatacagtgatcacaggcatctcaggatttcatcgtgctcatccttacttcaaaattttgttaattattgggtctttggcttgattatgggcttttttgtttgttggctttttgagatagagtctcattctgtcacccaggctggagtgcagtagtgcaatcttggctcactgcaacctccaccttcaaggttcaaaggattcttgtgcctcagcctcccgagtagttgggattacaggtgtatgtttccatgcccagctaggttttttgtattttcaatggagatcgggttttgccttgttggccaggctggtcttgaactcctggcctcatatgatccgcctgtctcagcctcctaaagtgttgggattacaggtgtgagccactgtgcgcggcctaattatatttttttaatacactagtaaagaagtgtatatatcacattttttagaacatttgatacacatttttcagttatttctttgtggttctgtgcatttaaaaacactctgtgaaggggtctataggcatcactgggctaccacagtggttcataacacaaaaaagcgtaaataccccaataatgtttccttatgaacggaactagaaagcctagaagaagagatgtgtggattgaaaaaatgttctcaaaaatgggagtgacttgatttattttgaatgctgaagggggaaagttgaagctggaagagagaaggggacagctaaaaggactcaggggagttgtatgaggaatggtccagagcacaggcggagggattaggtttggatgagaggagaaggggaaggcatttcattcttggagtccccagattaggttagaggccaggtggggatgggaagctgaggaattcgtattttataacattctttaattctggagtgagactggggcccatgtcacctgtagtaaggtggtagaataggagcttgagaagcataagaaatatttaactcaattcttgagtgtttcttgaaggttaggcatcgtgctaaaacttgggatatgaagataaataaggcatgatcttctgcaaacaactatactttgtggtgaagaacagagacaaattagctcagaaaaggtggcactggatttggccttaggttggagggctggaggaggtcagctaggtggcatttgagcagattcggaggttgagtataagactgccagggaaagttgaaaagggagaagggtgaggatttgcagtggcatggatgtctggacaagcaaggctaataagaaaaaaaaaaacaaccctttttctggagatataatattcatatagaaaagttcataaaccacaagtttacagctcaatgaattttcacaaagcaaatgctcccatgtaaccagcacccaaatcaagaaacagaacatcaccagcaggcagggcccatatgtgaggcagaaagtgttagaatttggagaggaggctggaggagtaggcagggtcttgctgtgttgggtgtgggagctgggaggggaggaagggtctggcgtgcagagatggacgttacatgacttctgcctttacggtcaaggtgtaattgtttttctaccggttttgtaaaatgactgttactttgtaaaatttgggtaaagacaccatatttcccttgcttatttatttatttatttatttatttattttttgagatggagtctcactttgtcacctaggctggagtgcagtggcgcgatctcggcttactgcaagctctgcctccgaggttcacgccattttcctgcctcagcctcccaaatagctgggactacgggcaccctccaccatgcccggctaatttttttgtattgtttttagtagagatggggtttcaccatgttaggcaggatggtctcaatctcctgacttcgtgatccacccgtctcggcctcccaaagtgctgggattacaggcatgagccaccacacctggctccccttgcttatttagaggagagaactttcttactaaataattatttcacttttacattatttaagattttggaggggtatttttaaaaggcttatttgaaaattaattttgtttctctattttctctttttactcagggttattatgtgtaccgtgacatgctaggcgaaaaaggagatttcattacttcacctgaaataagtcaaatctttggggaggtaatatactatgtaaagtatgaatgaagctaatataaacatttgagagcagatcaaattgtattattctgtagtagtgttctacagctttttttgtgattcatcaaaagttttaactttatagtagtttatgtactgagggaatagagaggcagtagaggggagtaaaatggtagagagaatatttgaaaagtttatactccactgtaggaagggaaatggagagataagagggacaaagagaaagagaaggaaaggagggggtcataaagaggacagaaaaaggagaatcagatgaaggaagagaatggaagaaggggccaggcgtagtggctcacacctgtaatcccagcactttgggaggccgaggcaggcggatcacaaggtcaggagatcaagaccgtcctggctaacacggtgaaacgcagtctctactaaaaaaaaaatacaaaaaattagccgagcgtggtggcggtcgcctgtagtcccagctacttgggaggctgaggcaggagaatggcgtgaacccgggaggcggagcttgcagtgagccaagatggcgccactgcactccagcctcggcgactgagcaaaactccgtctcaaaaaaaaaaaaagagaatggaagaaggaagagagacaaaaggaaaggcgaggaaagaggtagagtgcccaggagagtgcccgggaaggaagagagaaaagataaagagcattgaagaattagtggaattaagagaagctctaaagctcccagtcatgattttagccgtacttacagtaaaagtcttcttttatttatctattttttgagccagggttttgctcttattgcccaggctggagtgtagtggcgcaatctcggctcactgtaacctctgcttcccgggttcaagcgattctcctgcctcagcctcccgagtagctgggattacaggcatgtgccaccactcctggctaattttgtatttttagtagagacagagtttctccatgttggtcaggctggtcttgaactcccgacctcaggtggtccacccgcctcagcctcccaaagtgctgggattataggcgtgagccaccacgcccagccaagtcttcctttaataaacagaattctaattcatttccactaagtaccttctatgaatttagaaataggaaatagtgtatacgaggaagtagaatgtgcgtatcgaaaaacattagttattataagaatcatgtaattgtttaaatcatatgaatatgaagaaatggcataatcacatttcatatgtttatttgctttcaaatactaatacctttctgctagtgatatcctcttatctatgtcatgggaccttttatagcagaggctgccttattttttcctattaatcttcctaaatggtgtatgttatgatgtagtcccaggaagttcctatgtgaacatgtacgtatgtattgaacaacatacatatggctgtacacattttgctttttggcatatagtgcatatttatgtgaaattttatattgtggtatacttttatactttataatactttaatatgtgttttttttttcccttttcacagctactaggtatatggttcattagtgaatggatggccactggaaaaagcacagctttccagctggtggaactgggcccaggtaggggaaccctcgtgggagatattttgagggtaggtaataaaagaatgtcttctagtctcatataagtgaattttagtacttctgagtgtgcaaaccatgttgatttcattggttttcagttccttaatttcatatttctcagctaaaatataatgtcagaataatgtaatcagtcattacttactgttgtctgtaaacttaaaaattggaggggagggggagaatatgaaagctaaaaataggaaacatttagaagacattatgggagagtgtatttgtttcctcaggaaggaaagttgttaattatattaaaagtttaggccaggcatggtggctcaatcctagcactttgagaggccaaggtgggcagatcacaaggtcaggagttcgagaccagcctgaccaacatagtgaaaccccgtctctagtaaaaatacaaaaattagctgggcatggtggtgtgcatctgtaatccagctactcaggaggctgaggcagggaatcgcttgaacccaggaggcagaggttgcagtgattgctgcagtgattgattgcagagctgagattgcgccattgcactccagcctggtgacagagcgagactccgtctcaaaaaaaaaaaaaagtttaggctgggcaaagtggctcatgcctgtaatcgtagcactttggggggccaaggtgggaggattgcttgaggccaagagttcaagaccaacctggccaacaaagcaagacctcgtctctttttatattaaaaaaaaaaaaagcagaaggcataaagcaaaagattaatatttcatttcttacattaaaattaaaaacttcttgctctacaaataaactagcagctttttgttcttcagagaccccattaagagagtgattagacaagccacagagtgggagaagttatttgtaacacgtaaccaacagagaactagtagttagaattatttaaataactcctttaggtcagtaagaagacagataacttgagaaaaatcaggccaaagatgtgaacaagtccattcataaaagaggaaaatacaaacggctaaaaaagcaaaaaaaaaaaaaaaaagattagtcacattggtagtcaggaagatgaaaattaaaatcacaatgagatactactgtaacccttgccagattagaaaaaaaagctaaaagtctgtcaacaccaagtattggtgaagatgtggatttgtggatcaatggcaactctcatatactgcttgtaaaactataatttagtacatccttttttctttctcttttttttttttttttttgagacacagtctcactttgtcactcaggctggagtgcagtggtacgatcttggctcactgcaacctctgcctcccaggttcaggcgattcttgtccctcagcctcttgagtagcagggataataggcgtggatcactacacccggctaatttttttatttttagtagagaaggggttttaccatgctggccaggctgatcttgaactcttggcttgaagtggtccgcctgcctcggcctcccagagtgctgggattacaggcatgagcccccgtacccagccttgtacaacctttttgaaaagctattggccattatctattaacatcaaagtttcttatattgtatgacccagcaattttactgctagtgatataccctagagaaactagtgtatatgtgtaccaggagacacatacaagaagatagcagcattgtataaaatagcggaaaataacagcacaaatgcccatcggggggtaaatgaatcagttaattgtggtatagtcatacagtggaatacgaagtactgcaagaatgcgtgaaatcacagtggaatataacagtgttcaacatgaaacaagatgtgtgaaagtagcagtttgcaagagttcgtatcatatgattgtatttatataaaatccaaaaaatagtcaacattaaacaatatgtatttggtgataaaaatatatttagtaacatttataaagaaaagtcagggtgttattaactcaagattcagaatggtggtgacttccaagggtagagggagtccacaggggctttggagataaggtcatgtcccatttatggtagatattctctcttgtatcattgtttctatcagtctacgtactattttatgaaaacattaaaaaggaggacagttgtttatagtacctgataagtaatagtatttattaaacttttgtagtttttagtattttggaactcattagtgtttttgagtttattttatatgtacttgacaattcaatgtaaaaaacaaacatggctgggcgcagtggcccatgcctgtaatcgcagcactttgggagttcgaggctcccaaagttcaagatcagcttgggcaatacggtgaaactccatctctacaaaaaatacaaaaattacccagtcgtggtagcatgcgtctgtggtcgaagctagttgaggggctgagatgggaggattgcttgagcccaggaggttgaggctgcagtgagctgtgattatgcctctgagtaacaaagtgagaccctgtctcaaaaaaaaaaccaaaaaacaccaacacatactcaatataaatttaaatttcttgatgctttatggtttttgctttaaattagaaattaaaggatttaaaaaatatataaaatatataaacatatgacaaataagaatcttgattatttgggtgaagaaagaaaacaaaatcacgaatttaaatttccagggctctattttatgtttttcagcaaggtcatttgaatataaaatatttaataaggacctcaaatcatattctcttgttcaagtactttaaaagttgattccagagcccttaaaatgtatgaaggatgcttttccagactgagtcataagaagtcctaaaagccaaagaatttaaagggttgtaaagcaaatagccagagaagtgtcagacctgttttatttttgatgttaccttctgaaggaatttctcctgggaagtttttccatttgtatttcgatctcaaaactaaatttggaaaaatcatcttgttcatattatcagtctggatgtgcatattcatatctcaaaagtattaattggaggcagatcaccagtagaaattaaattcaaatgaaaaataatgttgatacactttatgcttttgctattgattttttagccttaaaagattggtaaaatattagtattttcctttttcccttgcatgtttacaacagtgaaaaaatgtgtagctaaatatagattgaaaatgtggcagacccccgagttaagcagtcaggttttcagtaccattcagatttggttctttgaggttagagttctcatcatctcaaagatgagattacttcctagacctagagatgttatcaaatcaaggctgtgtacattttatttccttggtctttttttagactccataatctgaatcattgtttttatcagatgccaaatcttttattttcatttgttaatcataatttatcattaggaaaccaaattgtgcattgttcatttcttatttagattatgcttaataactagtaggttaggattcttatagactgctggagagtggcttgggtaaggaacacatctctctgaaatattacctctattgtgacatgactaaatcattgatgtaaatgattaggaaacttaaaacctacttaacacattgtatttttttttcttcttttggtatttaggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaaggtaattacctttatgtggattaatgaaagaattttgatcacaaccctcacagtattgatgggactgtaactttttacagcaatataatagattgagttactgctgccaagtcccttatccatagagagtagcctacttttttctagaaaagagcatcttaatagaaaataaagttgcctgacattaagtagtagtttatttcatgaagctttgtaaaatcccaaacaaaatgtaaatctcctttgtacttttgagtatttccctatagctagggttgtaccgatgacggagcagcccaaggcagctggggctgatggaagcagtgttagtaggtgggtttagttcagttatagagtcttttaaaaaatccttacttgcctaaagacaagcaag

SEQ ID NO: 9344 - DNA, 141 bp, Homo sapiens
cggtggctcacacctgtaatcccagcactttgggaggccaaggtgggtagatcacctgaggtcaggagtttgagaccagcctgaccaacatggtgaaaccccgtctctactaaaaatacaaaaactagctgggcatggtgg

SEQ ID NO: 9345 - DNA, 4582 bp, Homo sapiens
gaattctgtgaaatccagtctgtgccactggccattgggctgactgggcagcggttgctgggagtgcctatcattgtacaggcttcacaggtgagcaggctgagaaacagacataagattttaaggggagagggaatgtgggacatgacccatcatttcctccttccccaggcagagaaaaaccgactggcagccatggccaacaacctgcaaaagggcaatggtggaccaatgcgcctctatgtgggttccctgcacttcaatatcactgaagacatgctccggggcatctttgagccctttggtaaagtgagtagaagtgagagaaacctctgaagggaattggaagaagtggggagggtgagtgtttgagtgtacttctctgttgtgcctggccgtgattaacttgctgcatacgtcatagtgggcatatgagtctatgctgtgaaagtttggctccatctctgttcatgtgcttggtggacaaataagttagacacaaatcaaataataggccaggttaagaaagattaaaaaatacaaaaattagccaatgtggtggtgcacgcctatagtcccaactagtcgagaggctgaggtgggagggtcacttgagcctgggaggtcaaggctgtagtgagcctcggaaaaaaaaaaaaaagtccaccttttaccaaaatatttctactgactaatctttttttttccgagacaaggtctcactctgtcacccaggctggagtgggtgagactttttgagactctgtctcaaaaaaaaaaaaaaagcagtctgggtaggaaagattgaagatgtgggctagtcaaaagtttactgataatttctcactcttctacagattgataatattgtcctgatgaaggactcagatacaggccgctctaaaggttatggtttcatcacggtgagtctctagtcttttaatttttttattttactttgggtttgtccacttgtctgattttgcagcttagcttcatcctcctcctttaggaactgtctaaatgacccataaaccctggtgcctgaagcttggactagccttctaccccttgagatgagtgcattgcttgagatcttggctttgctcctacactctgtcagtggccctggtatgggggtgttcaggagttcacccagcttccctggtgctgcaacttggctctttgggtaatagtaaccaggctgcagctaaaaggttgggggtgtgagggaggttaggtatgggcttttaaagacatgctttatagaattgatgtttctcataacagggatgggaataggaaattatacttccctctggtgctaccccatttgaagcaatttctgcaccgagaaggatcagttattaacgtagcactatggggagaatagtgaggccacctaattatgggcaagcttcaccttttcctgacattccaacaaaatggttgccaattcctataactggttcttccagccccatgtgactccaggctgagaactggctgccagccacaaagtctgatagaagcttgtattttctgggcttaaaccaggcagcatacactcccacagtgacccacagggcagagggcagtaggttgtattctgtcattggaattgctcacctcaaaaatatccagtaaaggcaagccatgtataacacctgcctaggaactgtcagtaccacatgccaggccctaaggcaggtaatgctgctagctagctaaacaagctagctgtggtgttgacaattctgtggtggcaagtaacttttgtaaccttttctcgctctctgtgtgactgagatatggaaaggcttctgtggggcatttttgcccttgcattgttgccttttgggtcaacaaccttgacacttaaacaaacagcagactgggaatcctctttgtaccagtgtgttgctgggtgctgctgataaaagggactagagagtaaaggccttctggtcagcaggtcacttagtcaacagctcttgtgtgtatgtgggggtgtgggttctgccttgctgtcagcactagggtgtgttccctcttaagcctggaattaggagttccagattcctagtacttaactaaaatttggccaggcgcggtggctcacacctgtaatcccagcagtttgggaggccaaggtgggtgaatcgcctgaggtcaggagttcgagaccagcctgaccaacgtggtgaaaccccatctctactaaaaaataaaaataaaaaaactagctgggcatggtggtgggtgcctgtaattccagctactcgggaggctgaggcaggagaattgcttgaacccaggagatggaggttgtagtgagctgacatggtgccactgcactctagcctcagtgacagagtgacagagtgggactccgtctcaaaaaaaaaaaaaaaaaaaaaaaaaaaagactaaaacttactaggatagagaactgaattaaaagcccaggagccttgttcttagcttgtcttccatttgatatacccatttgtgaaataacttgtcaggctaggtttcctacaataataaaattttgcattgttagattcttaatggagctgaaagattgaaaagtgactgccattgagtccattggaaaaggtccttttcagagaaccattttgaggtgatgggcctaggtcatattttctgggaaagaaaagtttgtacctcagtgagcatacaattttcctgggatagtaggactagggagtgttactgggtctttgagagcatgtctttggtgagtaggtgactaacatggcctgggtttctcatagttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggtaaaatatctccgcaaggtgaagattatggggttgaattttagatgaagggttggggcttaatcccaccttttcttttccttttaggcgctggaatccaactgccaagcactgctgctgctgctgctgccgccgccgcccaggctgctgccttgcaactgaatggagcagttcccttgggggccctgaatccagcagctctgactggtagtcttggacatgggaaaggaagggaaggtttgggggtctggaaagaaggagtgcgcggtgcttgctcactcactctgcctgtctttgttctagctctgagtccagccctgaaccttgcctcccagtgtttccagctctccagcctctttaccccccagaccatgtgagtctcagggtctagctcattctagcctttgattattctctttcctttggcttcccatttacctcttctttccacaggtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatcattgtgtttatttatttaaccacctttagaaagaaaaatgaaaa

SEQ ID NO: 9346 - DNA, 10791 bp, Homo sapiens
atggcatctgatgactttgacatagtgattgaggccatgctggaagctccctataaaaaagaagaggtaatattttccacctcactcctggaattgggttaatgagaaagagtagttgtcgatcatcactttcaactttcaacattttatgaatcctctttccctgcttatttattatgtagaataactaatcataaaaggcatagtcttagtaagctttgctggagactatggttaagagccatacttttagagacaacctcagaaaccggagtgggcacataatgtggtgttggtaatctgtgctttgctcaaaactcgaagtgacacagtagaaagtcactgtacctcagacctagcaccaatttcttttttttttcttttgagacagagtctcgctctgttgccaggctggagtgcagtggcacaatcttggctcactgcaacctccgcctcctgggttcaagccattctcatgcctcagcgtcccaagtagctaggattataggcaagcaccaccatgcccagctaatttttgtatttttagtagagacggggtttcaccatgttggccaggatggtcttgatctcctgaccttatgatccacccaccttggccttccaaagtaatgggattacaggcgtgagccactgcgcccgtcccagtttcttttttaatatattttttatagagacagggtcttgctatgttgcctgggctggtctcgagctcccaggctcaagcgatctgccttggcctcccaaagtgctgggattacaggagtgagccactgcacctggcccacttaacagcaatttgcttgcttgcttgcttgcttttccctccctctgccctctcctcccatccctccctccttctcccttcctttcccccccaccgctttcttttttcctttctttttttttttttttttttttttttgagatgaagtttcactcattgcccaggctggagtgcagtggcgcgttctcagctcaccacaacctctgcctccgggttcaggcgattctcctgcctcccaagtagctgggattacaggcatgtgccaccacccctggctaattttgtctttttagtggagatggtttctccatgttggtcaggctggtctggaactcctgacctcaggtgacccgcctgccttggcctcccaaagtgctgggattataggtgtgagccactgcgcccagcctcttttttttttttttttttttttttttgagacagagtctcactaggctgcccaggctggagtgcagtggtacaatcccagttactgcaacctttgcctcccagattcaaatgattctcctgcctcagcctcccaagtagctgggactacaggcgtgtgccactatgcctggctaatttttgtatttttagtagagatggggtttcgacatgtcggcgaggctggtctcaaactcctggcctcaattgatccgcctgcctcagcctttaaaagtgctgggattacaggcgtgagcaactgcccccagcctagcaccaatttgtaactctcctgggaaatgttagtggagcagatgttgggtaactgaagtttgacatcaaaatctgtcatgctgatctcttccttttaggtagtttccttgattcctttcttactccctttgttaggaaataagggtgctgaaaatctggctagataatcaagtggtttgatttattccttgtccacctttgttccctttgcccattggaatctgtgtgtctgccaccttataccttgtgacattttcctggtgaatgcctcaggatgagcaacaaaggaaagaagttaaaaaggattatcctagcaataccaccagcagcaccagcaacagtggcaatgagaccagtggaagcagcaccatcggggagacaagcaagtgagtgtgggaggaagaaatgggttggcaacttggggaagggaaacagttttgtccattggaaaaataaccagaatagggagattgtttctgttaagactgctgactgttagtaatggctccacctaggtcatgagaataatggtgacttgatttaattatctagtcttcattttccagtgtagatttgtggattagtcctagcatcaatatacttcatttgaataaaataccaagaggggctgggcgtggtggctcacacctgtaatcccagcactttgggaggccgaggtgggtggatcacctgaggtcaggagttcgagaccagattgaccaacatggtgaaaccccgtctctactaaaaatacaaaaattagctgggcgcggtggcaggctcctgtaatcccagctactcaggaggctgaggcaggagaattgcttgaacatgggaggcagaggttgtagtgagccgaggtcgcaccatcgcactccagcctgggaaacagagtgagactctgtctcaaaaaaaaaaaaaatagcaagaggacccctgatttggaaacaccaggttttgcttcgcattagggggaaaaatggcctcttcagatgcctgacagctttcagggctgtaagttggtattgtgcaattgctgtgaaccactgctggatcatcttcgggtctttggttttttcatgctttctgtttcattctggccttactgtaattccttttctttggcagcaataacgaaaccttctctttaagaatttacactcctgacctggcgcggtgctcacgcggggctcatgcatgtaatcccagcactttgggaggctgaggcaggtggatcacttgaggccaggggttcaagatgaacctggccaacatagcgaaaccttgtctctactaaaaatataaaaaattagctgggcatgatggtacatgcctgtaatcccagctactcaggaggctaaggcatgaggatcgcttgaacctggaaggcggaggttgcagtgagccaagattgcaccactgcacgacagagcgagattctttctcaaaattaaaaaaaaaaaaagaagaatgtactctctttcacaggaagaagaggagtcggagccataataaaagcagggatagaaagcgcaggtcagtaattctgggccaggcacagtggctcgtatctttaatcctagcactttggaagccaaggcgggaggatcacttcaggccaggagttcaaaaccagcctgggcaacatagcaaaatcctgtctctacaaaaaatttaaaaattacccaggtgtagtagtacatgtttgtactcccagctacttgggaggctaaggctggaggattgcttgggcccaggagttcgaggttgcagtgagccgagattgcagcactaaactcctgcctgggcaacagatggagaacctgtctcaaaaaaaataaaaataaaaataaaaaattgaaacatttagcttaaaacacaaacacattgtacaactctacaagttttctttatgtccttattctataagcttttttctatttttaaatttttttgtcttttactttttaaacattattgttattgttgaaaactacgacacaaagacacatgagcctaggcctgcagagggtctttcacctccacatcttgtcccactggaaggtcttcaagggcattaatacacatagagttgtactctgctgtaacagtgctttctttaggagcaccttctgaaggaccagcctaaggctgttttatagttaaccgaagtagaagtaatatattctagaatgataaatatagtaaatacatgaatcagtgacatcattactttttatcgtgaagtatatactgtacgtaattgttttatttttaaacaatttttaattgatacatattgtatgtagtttctggtatgtgtgaaatttaatacatataatttgtaaagatcaaatcagtgtacttgagttatccttgacctaaatgtttatcttttcatgatgctaggaaacattcaaattattctctactagctattttgaaatgtataatagattattgtacactgtagtaataaccctactgatttgttgaacactgggtcttattttttcttttttttttgagaccgagtttcgcttttgttgcccaggctggaatgcaatggcgtgatcttggctcaccgcaacctctgcctcccaggttcaagtgattctcctgcctcagcctcctgaatagctgggattacaggcgtgtgccaccatgcctggctaatttttttggtttgttttttgagacagagtctcactctgttgcccaggatggagtgcagtggcgcgacgtcggctcactgcaacctccgcctcccaggtttaagaagttctcctgcctcagcctcctgagtagctgggattacagttgcgcaccaccacacctggctaatttttgtatttctggtagagatggggtttcaccatgttggccagactggtctggaattcctgatctcaagtgatccacccattttggtctcccaaagtgctgggattacaggcgtgagccaccgtgcctggtctaattttgtgtttttagtagagacggagtttctccatgttggtcaggctggtctcgaactctcgacctcaggtgatctgcccgccttggcctcccaaagtgctgggattacaggcgtgagccaccgcgcccagccctgggtcttattttttctattaaatgacatatttgtatccattcatctacttctgttcattccacccacagccgccatccttccatccttccatccttcccagcctctagtaaacactagtctttctatcttcatgagattcactttgtacataattggatgtgctgtatttttatacaactgggagtgcagtaggtaatagtttggtttacaccagtatcaccacaaacacataagtaatacattacgacattacagtggctgtaacatcactaggttatacgaacttctcagcaccgttataatcttatgggaccactgttgtatatgcacttggttgttggcctaaacatgatgtgggcatgactgtagttgtttccctctgtagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactgggtatcactttttgctaatagattcacttttgtataataatctggataaaacaacaaatgcactatgaaccctgcttgagggtgcttattataacacattgtgattggcaggatactcaggcacagaaagggttggtattcaaaatttactggtgtggtggctcatgcctgtaatcccagcactttgggagactgaggccagaagatcacttgggctcaggaattcaagaccagccaggacaacatggcgaaaccctggttctacaaaaaatgcaaaaatgagctagatatggtcatgtgtgtctgtaatcctagccacacaaggaggctgaggtgggaggattgcttgagcctgggaggcaaaggttgcagtgacccgagatggcgccactgcactccagcctgggtgacagcggaaaccctgtcttaaaaaaacaatgagatgaagtactggaatctggttttctcaccatggaagacccagcattggaccaatgagaataaggtttcaccttttgtttttctctattctttagttataggtatggacacagtaagagtcctcatttcagagagaagagcccagtcaggtgggttgataatgaacactgttttagggattgtgaggtatgaataaaaggttatttgagccaaattacaggaatgtgtaatacttgagggttagctggagaacaatgaccaggtattgggagggctggtctcaacacatttcactcttcagggagccagttgataatctgagtcctgaggagcgtgatgcccgcacagttttctgtatgcagttagctgcccgaattcggcctcgagatctggaggactttttctctgctgtaggcaaggtaaccctcccaccttagttttcttctgagtagcttagcttgtatctccctttatgcctaactcaggatttcttttgcgtcctggataggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggtgagcaggctgagaaacagacataagattttaaggggagagggaatgtgggacatgacccatcatttcctccttccccaggcagagaaaaaccgactggcagccatggccaacaacctgcaaaagggcaatggtggaccaatgcgcctctatgtgggttccctgcacttcaatatcactgaagacatgctccggggcatctttgagccctttggtaaagtgagtagaagtgagagaaacctctgaagggaattggaagaagtggggagggtgagtgtttgagtgtacttctctgttgtgcctggccgtgattaacctgctgcatacgtcatagtgggcatatgagtctatgctgtgaaagtttggctccatctctgttcatgtgcttggtggacaaataagttagacacaaatcaaataataggccaggttaagaaagattaaaaaatacaaaaattagccaatgtggtggtgcacgcctatagtcccaactagtcgagaggctgaggtgggagggtcacttgagcctgggaggtcaaggctgtagtgagcctcggaaaaaaaaaaaaaagtccaccttttaccaaaatatttctactgactaatctttttttttccgagacaaggtctcactctgtcacccaggctggagtgggtgagactttttgagactctgtctcaaaaaaaaaaaaaaagcagtctgggtaggaaagattgaagatgtgggctagtcaaaagtttactgataatttctcactcttctacagattgataatattgtcctgatgaaggactcagatacaggccgctctaaaggttatggtttcatcacggtgagtctctagtcttttaatttttttattttactttgggtttgtccacttgtctgattttgcagcttagcttcatcctcctcctttaggaactgtctaaatgacccataaaccctggtgcctgaagcttggactagccttctaccccttgagatgagtgcattgcttgagatcttggctttgctcctacactctgtcagtggccctggtatgggggtgttcaggagttcacccagcttccctggtgctgcaacttggctctttgggtaatagtaaccaggctgcagctaaaaggttgggggtgtgagggaggttaggtatgggcttttaaagacatgctttatagaattgatgtttctcataacagggatgggaataggaaattatacttccctctggtgctaccccatttgaagcaatttctgcaccgagaaggatcagttattaacgtagcactatggggagaatagtgaggccacctaattatgggcaagcttcaccttttcctgacattccaacaaaatggttgccaattcctataactggttcttccagccccatgtgactccaggctgagaactggctgccagccacaaagtctgatagaagcttgtattttctgggcttaaaccaggcagcatacactcccacagtgacccacagggcagagggcagtaggttgtattctgtcattggaattgctcacctcaaaaatatccagtaaaggcaagccatgtataacacctgcctaggaactgtcagtaccacatgccaggccctaaggcaggtaatgctgctagctagctaaacaagctagctgtggtgttgacaattctgtggtggcaagtaacttttgtaaccttttctcgctctctgtgtgactgagatatggaaaggcttctgtggggcatttttgcccttgcattgttgccttttgggtcaacaaccttgacacttaaacaaacagcagactgggaatcctctttgtaccagtgtgttgctgggtgctgctgataaaagggactagagagtaaaggccttctggtcagcaggtcacttagtcaacagctcttgtgtgtatgtgggggtgtgggttctgccttgctgtcagcactagggtgtgttccctcttaagcctggaattaggagttccagattcctagtacttaactaaaatttggccaggcgcggtggctcacacctgtaatcccagcagtttgggaggccaaggtgggtgaatcgcctgaggtcaggagttcgagaccagcctgaccaacgtggtgaaaccccatctctactaaaaaataaaaataaaaaaactagctgggcatggtggtgggtgcctgtaattccagctactcgggaggctgaggcaggagaattgcttgaacccaggagatggaggttgtagtgagctgacatggtgccactgcactctagcctcagtgacagagtgacagagtgggactccgtctcaaaaaaaaaaaaaaaaaaaaaaaaggactaaaacttactaggatagagaactgaattaaaagcccaggagccttgttcttagcttgtcttccatttgatatacccatttgtgaaataacttgtcaggctaggtttcctacaataataaaattttgcattgttagattcttaatggagctgaaagattgaaaagtgactgccattgagtccgttggaaaaggtccttttcagagaaccattttgaggtgatgggcctaggtcatattttctgggaaagaaaagtttgtacctcagtgagcatacaattttcctgggatagtaggactagggagtgttactgggtctttgagagcatgtctttggtgagtaggtgactaacatggcctgggtttctcatagttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggtaaaatatctccgcaaggtgaagattatggggttgaattttagatgaagggttggggcttaatcccaccttttcttttccttttaggcgctggaatccaactgccaagcactgctgctgctgctgctgccgccgccgcccaggctgctgccttgcaactgaatggagcagttcccttgggggccctgaatccagcagctctgactggtagtcttggacatgggaaaggaagggaaggtttgggggtctggaaagaaggagtgcgcggtgcttgctcactcactctgcctgtctttgttctagctctgagtccagccctgaaccttgcctcccagtgtttgcagctctccagcctctttaccccccagaccatgtgagtctcagggtctagctcattctagcctttgattattctctttcctttggcttcccatttacctcttctttccacaggtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatcattgtgtttatttatttaaccacctttagaaagaaaaatgaaaa

SEQ ID NO: 9347 - DNA, 327 bp, Homo sapiens
gctgggtgcactggctcacgcctgtaatcccagcactttgggaggccgaggtgggtggatcacgaggtcagttcaagaccagcctggccaacatggtgaaactctgtctctactagaaatacaaaaagtagctgggcatggtggtgggtgcctgtaatcccagctactcaggaggctgagacaggagaatcgcttgagcctgggaggcggaggttgcagtgagccgaggatgcaccactgcactccagcctgggcaacagagcgagcctccatctcaaaaaaacagaaaagtgtatttctcacagttctggaggctgggaatttcaa

SEQ ID NO: 9348 - DNA, 4582 bp, Homo sapiens; identical to SEQ ID NO: 9345

SEQ ID NO: 9349 - DNA, 10791 bp, Homo sapiens; identical to SEQ ID NO: 9346

SEQ ID NO: 9350 - DNA, 327 bp, Homo sapiens; identical to SEQ ID NO: 9347

SEQ ID NO: 9351 - DNA, 14162 bp, Homo sapiens; identical to SEQ ID NO: 8957

SEQ ID NO: 9352 - DNA, 664 bp, Homo sapiens; identical to SEQ ID NO: 8958
  misc_feature (335)..(335): n equals a,t,g, or c

SEQ ID NO: 9353 - DNA, 2767 bp, Homo sapiens
gaatgcagtgatttttcacctccgataactgtaatcctgttgatcttcctgtgccttgagggtcttctgtttttcactttcactgcagttatgtttggcacccaaatccactccatatgcaacgacgagacggtaagctttgttctcggctgtgtggacttcatatgtggtccaagcttgagtaaatgaaaagtcctaatgtcaacaataggtgcctgtggactgactcgggaacgtaatgggacggtcttgatgagctgcaaccagctccctgtgtttgctgtttctttcattctgggcagtgcatatttctagtctcagtttgatttgcaagtcagcagagccaggcagattcccagctcccagtgcagtcagtaaatttcagggaactgactgcctttagggcctggctctgcaggcctggagtggcgctcagtaaatgtctgtacacagtaactaacgagcgacaaatgttggtgcctggctgggagggccattgtggtagtctgggctggccacgtggctgcagccgggctgggctcacagaggccacggggtctggatcggggcagagctgggaaggagagttcactcacctaccctccatcgagcccacactgtgcttgagcacggtgtgattctgaggcttggtggggtctgccgagcttcctggagccgctgccacttgcttttctttctgcttccaggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaa

SEQ ID NO: 9354 - DNA, 1326 bp, Homo sapiens
atcccactcaatcttacctgtactatttgccatctcctctcaatcaagttcattccataatgatgttttcctgagtaaaccagaaaaaaaagaatccttataaataggcaaagattacttagtaaaataggcaaaggctctcagagccttttttctcatgtgacatgcatgtatctgaataggaacttcttgtttctggctgttgaattatccaaaaggatggctttagtggtaagttttgtgcataaaggaaaggaaggcatgttagccagtggagaatacatttaggccacagggaccttgtggtgcttcttggattacgctgggctttatgcatggatagcagatgaggccaggggaggaaaaactctagagatggaaggatggatggacaaaggaagaagagaagaaagagagaataaatagcatatgcaatatgttgaatttgcactgctagcaagcaagaacttaagtcacacacatacccagagccaggccctcaggaatatttctcaacctttatgctttactcttctccagatagtaaaacacctacaaaatatcatcaggccttgttcttcagcatgacaaaatgtcctgcttcttgcctctgtgaacaagggggactgagattgtatctcctttccacaagagcccttgggatcaacacctatggaagggaagggaggaatggaaaaaaggggagctgagctgggatgcagatctgctagatgcctcagacaaccctgcggggagttatggagatggaatgccctttagaattgtccagggttcaggagacaggggaggcctttttatacctgcatcacctagtcactgggtatgcttgatggggaagaatcatgacgttaggagagggaggtggctctctgaagctgtagcaatccccaaagggggcagacctttgcagatgaggtctttcttctggcagcactcccagaaactaaggtaaagtctccgttattcctgagggggatccggatggcttatcatgtccatcacactccacaatgctatataataccataaaactttgcaaatagaatgaaggagaaaataaatattgcaaaagcatactgtcaaatttctacataacagaatattaggtttgaaaatattacccattagttaaatttctcctccttttacaatgatgtttgcctttaaaggggtcaccagagaataatttgtttcacagagcagccatgctattaatactactgtttagagatatagaaacgactttgcaactgtgaattgctaagaattgtagaaataaagggaaaataaaattttcttttctaa

SEQ ID NO: 9355 - DNA, 1326 bp, Homo sapiens
atcccactcaatcttacctgtactatttgccatctcctctcaatcaagttcattccataatgatgttttcctgagtaaaccagaaaaaaaagaatccttataaataggcaaagattacttagtaaaataggcaaaggctctcagagccttttttctcatgtgacatgcatgtatctgaataggaacttcttgtttctggctgttgaattatccaaaaggatggctttagtggtaagttttgtgcataaaggaaaggaaggcatgttagccagtggagaatacatttaggccacagggaccttgtggtgcttcttggattacgctgggctttatgcatggatagcagatgaggccaggggaggaaaaactctagagatggaaggatggatggacaaaggaagaagagaagaaagagagaataaatagcatatgcaatatgttgaatttgcactgctagcaagcaagaacttaagtcacacacatacccagagccaggccctcaggaatatttctcaacctttatgctttactcttctccagatagtaaaacacctacaaaatatcatcaggccttgttcttcagcatgacaaaatgtcctgcttcttgcctctgtgaacaagggggactgagattgtatctcctttccacaagagcccttgggatcaacacctatggaagggaagggaggaatggaaaaaaggggagctgagctgggatgcagatctgctagatgcctcagacaaccctgcggggagttatggagatggaatgccctttagaattgtccagggttcaggagacaggggaggcctttttatacctgcatcacctagtcactgggtatgcttgatggggaagaatcatgacgttaggagagggaggtggctctctgaagctgtagcaatccccaaagggggcagacctttgcagatgaggtctttcttctggcagcactcccagaaactaaggtaaagtctctgttattcctgagggggatccggatggcttatcatgtccatcacactccacaatgctatataataccataaaactttgcaaatagaatgaaggagaaaataaatattgcaaaagcatactgtcaaatttctacataacagaatattaggtttgaaaatattacccattagttaaatttctcctccttttacaatgatgtttgcctttaaaggggtcaccagagaataatttgtttcacagagcagccatgctattaatactactgtttagagatatagaaacgactttgcaactgtgaattgctaagaattgtagaaataaagggaaaataaaattttcttttctaa

SEQ ID NO: 9356 - DNA, 1326 bp, Homo sapiens; identical to SEQ ID NO: 9354

SEQ ID NO: 9357 - DNA, 1074 bp, Homo sapiens
tttgtttgtttttgtttttgtttttgagacggagtctccctctgtcgcccaggctggagtgcagtggtgccatctcagcttactgaaagctccgcctcccgggttcacgccattctcctgcctcagcctcccgagtagctgggactacaggcacctgccaccacgcccggctaattttttgtatttttagtggagacggggtttcaccatgttagccaggatggtctccatctcctgactcatgatccgcctgcctcggcctcccaaagtgctgggattacaggcgtgaaccaccgcgtgcttatttaaagtatgtgctgtctctctccttacgaatgtttttttttccctgttggtcactcattttcatgatcgttttccaattcttagatctgacttcatgcatgagaagtacagaaagtacacaagaataaagaataaaagtaggggagtcaggaatgttctattttaaaagcaactattagattcctcactgtctcccttcaattattcctgatctttactctttgagtcctccctgaaataacatgctattagattgatgcaaaagtaattgtcgtttttgccgttactttttttttttttttcttttttttagatggagtttcactcttgttgcccaggctggagtgcaatggtgcaatctcggctcactgcaacctctgcctcctgggttcaagcgattctcctgcctcagcctcccgagtagctgggattataggcatgtgccaccacacccagctaattttgtatttttagtagagatggggtttctccatgttggtcaggctggcctcgaactcctgatcttaggtgatcctcccgccttggcctcccaaagtgctgggattacaggcatgagtctccacatccttgccattactttcaatagcaaaaaccgcaattactttttcaccaatctatataatgattagaaatatatcccctactctggagggtgaggcaagtgatcctatcgcgtgaacccaagagtttgaggccagcctgggcaacatggggagattttgcctcaagaaaaaaaagaaaaaagaa

SEQ ID NO: 9358 - DNA, 16225 bp, Homo sapiens
gaagctgagtctgatagaacttagcccgtgaccttaatgggtactcggcagatgcagctgcctggctgattagagaacaggacaggcatggaccctgctttcggagcagtgctgtggaatagaactttgtgcagtgacggaaatgttctgcatcttcactctcccttatgatggtcagtagccacgtgtgaaatgtatctaatgggactgagaaactaaatttttaatttaagtagccacaggtagctagtgattaccatagcaaatgctgcagttccccaggtttttagtcttgattatacctcccagaagtcgtctgctccaaaggtcaacagttcagcaggaagcagagcccatgcctttgagaggctggaggtattgcatactcccaaaaatcccaggggctcactcataatgagcccaacagtgcagaagagttctgggctgttgtttctaaaatgcaagcatacagccttcctcctctcccattttcatttagacctgtactaacagaattctggcattacaaattgttttgtattttgatgtcttcagaataaatatataatgtgcttcataattgaaagcaattttgatggttttaaaatcaacattttttgtgttgctaccttgtgctgagacttgtgctagatagtgaggataccaagaaaaataagcacagggattttgtgttgttcatctttatctcctcagcatctaagataatacccaatgcatagtgggctctcagtagtgtttggtgaactaataagcgaaagatataatcgccactgtcaaagcactcactcactatgtggtgggggccaacagacaggtacagatgtgttcctggtgtggagaaagtgccagggtggctcagcgaagaaaaaagaattcttgtggtgctatcaagcaaggcttcatttgagggaaaagtaggatttctgtaggtggaaaaagagaagacattgatttgaaactccctggttgttttataaacttcatattagctatgtccacagagcctccaaaaggatataattcaaaagggattttaaccaaaatgaaatatgttgtgactaatagatacagtttatttgaatgaatgatagtttttcccatttgatattttaactgtgctacacaagaatgagagtagacatagctcgatttgtagtctcattgttctgtcttttctgcccatttcagtgacccaggactctttgtttattgctgtgatttttcttccacagctatagaactggtccaggtgagtacaatgggaaattacctattggtaatttccactgattaaagggaaaaggttctcctaaaaatcaaggtctctggctgtgttcttatacagtctgtgttcttacggtctaaaagtaaaagatttactgataacgagcataccttgttttattgcagttcactttatcacactgtatagatgtcgtatctgttcatatattgaaagtttgtggcaaccctgcatcaagcaagcctaccggtgccatttctccaccaccatatgctcacttagtatctatgtgtcatgctttggtgattctcagaatatttcagacttttttactgttatgtatgttatagtgtgtgatgttactgttgtacttggtttggggttccacaaatcacatctgtgtaagacggtcaacttaataaatgcatgcgttgtgactgctccaccaacctgccattccatttctctccctctcctcaggtctccttgttctctaagacacaatattgcaattaggccacttcatactctacagtgtcctctgtgtgttcaagtgaaaggaagagtttcaccacgttgcccaggctggtctcgaatgatagcttacacttgtgttgtaattattaaatttaatacacaattgcataaactaatgaaatacgattgcatgctggtgcggtgactcatgcctgtaatcccagcactttgggaggccggggtgggcagatcacgaggtcaggagttcaagaccagcctgaccaagtgaaaccctgtctctactaaaaatacaaaaaaattagccgggctaaaaatacaaaaaatggcgcatacctgtaatttcagctactcaggaggctgaggcaggagaatcacttgaactcaggaggtggaggttgcagtgagctgagatcgcgccactgcactccagctagacaacagagtgagactccatctcaaaaaaataaaaatacattattggtcggccacaatggcttaatgcctgtcatcccaacactttgggaggctgaggcagacagatcacttgagatcaggagttcaagactggcctaggcaacatggtgaaaccccatctctactaaagaaaaatacaagaaattatccaggcatggtggtgggcacctgtagtcccagctactcaaaaggctgaagcaggagaatcgcttgaactggggaggcaaaggttgcagtcagccaagattgtgccactgcactccagtctgggcgacagtgagactccatctcaaaaaaaagagagagaaagaaaaaaaaatagtttattgctaaaacatgttaataatcatctaaaccttcagcaagttgtaatctttgctagtggacggtcttgccttgatattgatggctgctgactgatcagggtggtgattgccaagggttggggtggtcgttgctaagggctggggtgactggcaatttcttaaaataaggtaacagtgaagtttaccgtatcatttggctcttcctttcatgaaagatttctccgtagcatgcgatgctgataggattttgcccacagtagagcttctttcaaattgaagtccattctctcaaaccctgctgctgctttatcaactaagtttgatgccatttcaaaacaaaaaacctttcttgccatttctaaacaatgttcatagcatctttactggagtagatttgatctcaataaaccactttctttgcccaaccgtaagaagcaactccttatagataaggatgctggtttaaaaagaaagaaagaaagaaagaataagactaaaaaacaagcagcaacaagattgcagcaattcagtcacatcttcaggcttcactttttttttttttttttttttgagacagggtctcactgtgttgcccaggctgaagtagagtgacacaatcatagcccactgtagccttgaattttgggctcaggcgaacctgatgagatgattccattggggttctttgagttacaagtaacagaaacgtctagacaaactcaaagcaataaagtagaatgtcatagaacctaagggcacaaaatacagccccaagttcctggtatcttacctgtcattgtccagggcccatttgttttttccctctttgcataccagttttctctagtcagtatttcctaattttgcacgcggccccaacgtgcttgctcctcccagtcccttacaagctcaccctgttcaggggttcatggtgcctcactaaaatgattgtgtcccagttctgaagtccctggaaagtctagttaacacaacctagctgataaatacagcagccctgtttgaatcagctttggccaatgagaaacaaactcacatatttgcagaagacggacattgagggtagatgccttaaaatgtatctgttatggctggggtcagtggctcacacctgtcatcccagcactttgggaggccaaggccagcggatcacgaggtcaggagttcgataccatcctgaccaatatggtgaaaccccgtctctactaaaaatgtgaaatttagctgggtttggtggcacgcacctgttgtcccagctacttgggaggctgaagcagaagaatcgcttgaacccaggaggcggaggttgcagtgagccgagatcgcaccactgcactccagcctgggtgacagagcaagactccatctcaaaaaaaaaaaaatgtgtctgttacaattggccgggcatggtggccagcactttgggaggctgaggtgggcagatcacttgaggtcaggagttcaagaccagcctggccaacatggtgaaaccctgtctctactttaaaaaacacaaaaactaggccgggtgcagtggttcatgcctgtaatcccagcactttgggaggctaagacgggcagatcatctgaggtcaagagttccagatcagcctggccaatatggtgaaactccatctctactaaaaatacaaaaattagccaggtatggtggtaggtgcctgtagtcccagctactcgggaggctgaggcaggagaatcgcttgaatctgggaggcagaggttgtagtgagccaagatcacgccattgcactccagcctgggctacaagagtgaaactccatctcaaaaaaaaaaaaaaaaatacaaaaactggcaggacgtggtggcatgcacctgtaatcccagctactggggaggctgaggcaggagaattgcttgaacctgggaagcagaggttgcagtgagccgagatcgcaccactccagcctgggcaacagaacaagactctgtttcaaaaaaaaaaaaaaaaaagagtctgtcacaattatgtacaatgctgttagggcagattaggaattggtagtgccatgcttttagaattattattcagttaaagaccaaatgaatattgaagcctacctttacttcagtttttgataacaaagtaaattttctacatctacagaaatagattttcctgaagaattctatggtttgtgtaatattttctagttgggagttgttttaaatcgtgtgctttgttgtttgttttgagacagggtctcagtcactcaggctggagtgcggtggtacaatcaaactcactgtggccttgatctcctgggctcaagtgattctcccacctcctgtgtaactgggactatgggcacatgccaccacacttggctaatttttttttttttttttttttttgcgacggagtctagctctgtcgcccaggctggagtgcagtggcgtgatcttggctcactgcaacctccgcctcccaggttcaagcgattctcctgcctcagcctccagagtagctgggattacaggcgggtgccactgcacccagctaatttttttgtatttttagtagagacggggtttcactgtgttggccaggctggttttgaactcctgacctcaggtaatcctcccacctcgacctcccaaagtgctaggattacaggcatgcacccggcatttttttattttttgtagagatgaagtctcactatgttgcctagctggtctcaaactcctgggctcaagtgatcctcctgcctcagcctcccagggtgctgggattctaggcgtgagccaccgtgcctagcagatcgtgcttttggtttgtttgtttgtttgtttttgtttttgtttttgagacggagtctccctctgtcgcccaggctggagtgcagtggtgccatctcagcttactgaaagctccgcctcccgggttcacgccattctcctgcctcagcctcccgagtagctgggactacaggcacctgccaccacgcccggctaattttttgtatttttagtggagacggggtttcaccatgttagccaggatggtctccatctcctgacctcatgatccgcctgcctcggcctcccaaagtgctgggattacaggcgtgaaccaccgcgtgcttatttaaagtatgtgctgtctctctccttacgaatgtttttttttccctgttggtcactcattttcatgatcgttttccaattcttagatctgacttcatgcatgagaagtacagaaagtacacaagaataaagaataaaagtaggggagtcaggaatgttctattttaaaagcaactattagattcctcactgtctcccttcaattattcctgatctttactctttgagtcctccctgaaataacatgctattagattgatgcaaaagtaattgtcgtttttgccgttactttttttttttttttcttttttttagatggagtttcactcttgttgcccaggctggagtgcaatggtgcaatctcggctcactgcaacctctgcctcctgggttcaagcgattctcctgcctcagcctcccgagtagctgggattataggcatgtgccaccacacccagctaattttgtatttttagtagagatggggtttctccatgttggtcaggctggcctcgaactcctgatcttaggtgatcctcccgccttggcctcccaaagtgctgggattacaggcatgagtctccacatccttgccattactttcaatagcaaaaaccgcaattactttttcaccaatctatataatgattagaaatatatcccctactctggagggtgaggcaagtgatcctatcgcgtgaacccaagagtttgaggccagcctgggcaacatggggagattttgcctcaagaaaaaaaagaaaaaagaaatatatccctctttgtgaagtagcaacagttacatttaaaatttaaaacaagataatcttttctttaggctatgttaatattttctaacttacctgtgtcttccatctgtctgcagacaaattcagaatatgatccttctcggtgttttgcctttgttcacgacctgtgtgatgaagagaagagttacccagtgcccaagggcagtcttgatattatcattctcatatttgttctttcagcaattgttccagacaagtaagtttgggtcccttggctggtagtgtcacaaaaaggaagctttggtgagggacctttttttttaaaataggttcttgctctgtcagcccaggctggagtgcagtggcacgatcatggctcactgcagccttaacctcttgggcttaaatgatcctccctcctcagcttcccaagtaggtgggaccacaggcacgtgccaccagtcctggccaatttttgtgtttttagcagagatggggttttgccatgttgcccagactggtcttgaattcctgggctcaagcgatcctcccaccttggcctcccaaagtgctgggattataggtgtgagccaccatgcccagcctggcgagggaccttgatattagagttgggctcaaagtaaaaagagttttgtttatgttctgatagacacaaagaagccacaccatttgtagtgatgtgagcatctcagccattttcctaaatttgtcttgatgtccaacttctgttctggcctcgaaacttctgcagtagttggttcttcatttccttgttgtggctcaacattgggaaagaatgggaaatcagtctctaatgagtatgtggggaaattcctattgatagtctcatcacatgccgttttagaactgtgaactgtgggtgtcacagctcttaggtaatgtctcattattggatttttattttattttattttatttttttgagatggagtcttgccctgtcgcctgggctggaatgcaatggcgtgatctaggctcattgcaacctccacctccccggttcacacaattctcctgcctcaacctcccgagtagctgggattacaggcacctgctaccatgcccagctaatttttgtatttttagtagatgcggggtttcaccatgttggccaggctggtcttaaactcctgaccttgtaatctgcttgcctcaaccttgcaaaatgctgggattacaggcatgagccactatgctggccttttttttttttttgaagacggagtcttgctctgttgccccggctggggtgcagtgatgagatcttggctcactgcaacctccacctcccgggttcaaccaattctcctgcctcagcctcccaagcagctgggattacaggtgtacgccaccatgcctggctaatttttgtattttttttttttagtagagatggtgtttcaccatgttggccaggctggtctcaaactcctgacctcatgacctcatgatccgcccgccacggcctcccaaagtgctggaattacaggcgtgagccaccacgcccagcctattggccttttaaatgctttaaataaaacaaccttattagcaacatgaaatttacattgaaccttaactaaggtgttctctgatgcttacagtgttttaggaaagtgtgatacagaattctataaaatcagattcagattaaaggaaagtcaaatgctatatcctaaaatacaccattaaaacttcatatgcataggtaaccagtggtcctgtgacactaccttctcttttttttttctgagatggagtctcactctgttgcccaggctggagtgcagtggtgagatttcagttcactgcaacctctgcctccaaggttaaagcgattctcctgcctcagcctcccgagcagctgggattacagacaagcaccaccacacctggctaatattttttgtatttttagtagagacggggtttcactatgttggccaggctggtcttgaactccttacctcaagttatccacccacctcggcatcccaaagtgctgggattacaggcatgagccactgcaacctgaccaaaactaccttctcaaggaagcagagtcagatggtggctcagagattcagataccattgactaattccatggaagcccttggcactgccagagtgcagtgagtctggacaggctgggggttggcacatgttagggtaaactatacccatgaaatcatgagattagagacttcaaacatctcctcattctgtgtcatcagagtcctgcaaaggatgattaagtaagttagtgttaaaggtcaaggtaagctggtgttaggaagccagattacatgactagagactgcagggaccagtgattgagatcctggtttatctcccagagtccaaggacccctcactggctgcacaggataggagctttgggtgattgaccttcctctagaaggccacacttcctctagaagggtactgaagtcatccaacctgagaggatgagtgtgaaataaaggcatatgcaggataacccaaaaggcctaccatggttttaaactttaataattgcagaggttgaccaggcacagtggctcacgcctataatcccaccactttgggaggctgaggtgggaggagtgcttgaagccaggagctcaagaccagcttgggcaacaaagcaggaccgttatctctactaaaaataaaaataaaaaaatttagccaggtgcatatctgtagtcccagctactcagaaggctgaggcaggagtatggcttaagcccaggagtttgaggctgcagtgaagtgagctacgatcacaccactgcactgcagcctgggtgacagagtgagaccctgtctcaaaaaaaacctatgaccttagaagtttcaatgctacaaactttttaaaaattgacatggactaaaacaaattattaaaatttaaaattcaagccagacacagtggcacacacttttagtcccagctacctagagactgaggcaggaggatcacttgagcccaagagtccagccgaggcaacatagcatagcaggaccccagctgttttttgtttgtttgtttgttttctgagatggagtttcactcttgttgcccaggctggagtgcagtgctatggtcttggctcactgcaatctccgcctcccaggttcaagcgattctcctgcctcagcctcccaagtagctaggattacaggtgcctgccaccatccctggctaatttttttgtatttttagtagagacagggtttcaccatgttggccaggctggtctcgaactcctgacctcaggtgatctgcctgccttggccgtttttttgttttttggttttttttaagagggaaacattcattatgcaaaatttaaatagactttgaaatttttttggtgaagtttgtagcatttagacttctgaagttatgaaagcttcaacctgcaccaagacttttgaagaacactgcatatggaaaacacagacctaagtgtaaaaccctctgtctgttatactcatttgcatactgattgtattgtaagttcttgaggacaagtcttcatttaacaaacagaaagatacagcccctacattgaaagagctcaggtctaatgatgcaggcagataagtcacctagcagaacccactggatgctcaggattcagctcagccacaggcgcacagggcaaagatggctatctaggacagtggggaagtgagccagatagagagcagagaacttttgtttgtttgtttgttttttggagacaaagtctcagttactctgcggcccaggccggagggcagtggtgcaatcttggctcactgcaacctccacctcccaggttccagaaattctcctgcctcagcctcctgagtgtctgggattacaggcacacgccaccacacctggctactttttgtatttttagtagagatggggtttaaccattttggccaggctggtctcaaactcctgacctcatgtgatccacctgcctcagcctcccaaagtgctggtattacaagcatgagccaccgcacccggccaggagcagggaactttcttacggcagaagcgggctgtcctcgggccccttcaggctgaaggcagtggatcgaggccacagctgtgagcaggcagctaatgtccttcagttctaactgaagcaagagtagaggagcttagatctcagacttggtgtgtcagttgaggaagtccactggctttttgggatatgctacagggaaagagaaccccgtctttaaggagacctgattgaccgtcattccctgctgctccacaggatgcagaaggctatcaacaggctgagcaggcttctgaaacctggcgggatgatgcttctgcgagattacggccgctatgacatggctcagcttcggtttaaaaaaggtattttgaaagtgctgaatcctaaccactagagatcatgtcctttgcagggacatggatgaagctggaaatcatcattctcagcaaactaacacaagaacagaaaaccaaacaccactttttctcactcataagtgggagttgaacaatgagaacacatggacacggggcggggggcatcacacactggggtctgtctgggggtgagggggctgggagagggatagcattagcagaaatacctaatgtagatgacgggttgatgggtgcagcaaacctccatggcacatgtatacatatgtaataaacctgcacgttctgcacatgtaccccagaacttaaagtataattaaaaaaaaaaaaaggtatttggccactataatcaaaaaatggtgctgccatcagaatagaaactctagaattagaactccttatataaagccatttaatatgtgacagagtagtatattttttaagaaaactgaagaggcttgtataatctagatattgaggtctttttaagcaagacagctacctttagaagagcttttattagaaagacatttgaaagacagccgggcgcagtggctcatgcctgtaattccaacactttgggaggccgaggtgggtggatcgcctgagttcaagagttcaagaccagcctgaccaacatggagaaaccctgtctctactaaaaatacaaattagctgggcatggtggcgcatgcctgtaatcccagctactcgggaggctgaggcaggagaatcgcttgaacccaggaggcagaggttgcagtgagccaagatcacaccattgcactccagcctgggcaacgagtgaaactgtctcaagaaaaaaaaaaaaagatatttgaaagacataaataattttaaatgtggcatgacaaaagatgccattaaaaatgtaaaaggcaaatgacggagtaagaaggaatattttcagtgcatataatagataaagacttaatatctttgctcttcaaggagctctcatgaaactgataaggaaaagatcagtgacccacccaaaaaacaggcgaggagtatttagtcagttcacagaagaacatatctaaatggccagtaaacaacacttcaaggaaataaaaataacgagttagtacttcctattgctggccaattcaaagaaagaggtgcattccttcattactggtagaaaaagaaattgttacagcctttttttttgagatggagttttgccgttattgcccaggctggagtgcaatggcgtgatctcggctcactgcaacctctgcctcctgggtccacccgccttggcctcccaaaatgctgggattacaggtgtgagccactgtgcccagtgttacagcctttttttttttgagacggagtctcgctctgtctcccaggctggagtgcaatggcacgatctcggctcactgcaacctctgtctcttgggttcaagcaattctcctgcctcagcctcccgaatagccgagactacaggcatgtgccaccacgcctggctaatttttttgtatttttagtagagacagggtttcaccatgttggtcaggctggtctcgaactcctgaccttaggtgatccacccacctcagcctcccaaagtcctgggattacaggtgtgagccactgcgctcggcttacagcctttttttaagcacccaattattgttcaatccagtcattttttttgaatatagtcaagaactagcacataatacatgcaggagcaaaactttgtaaacaaagtgaatgcctctggatagggagatgttgtgcttgtcacctgaggtggaccccgtaccactgaacttggagggatttctgttctgtattcagtgagaggagagcaatgtgcaagggagtattttaaactccatccccctataccagtatctgcagggaaataagtacacacttgtgtgatgatttgggcattcaggaaggtctagaagtatgtgccaggccggtaaactgaggtaaggtcagggaggttagcagcagaagggaaagcatgttcatgatcaaaacaatatctgagttgtatttatgattctgtagacatgtgaagagacatgcaaaggacagtcaccaccaaaatggtaatgattgtctcaagtttccttaaactcagctatattgcttaattaaaaaaaataaaaataggccaggcacggtggctcatgcctttaatcccagcactttgggaggccacggtgggtggatcacctgaggtgaggagtttgagaccagcctggccaacatggtgaaaccctgactctactaaaaatacaaaaaattagctgggcatggtggtgggaacctgtaatcccagctacttgggaggctgaggcaggagaatcacttgaacctgggaggcagaggttgcagtgatccgaggtcacgccattgcacccagcctaggcaacaagagcgaaactccgtctcaaaataaataaataaataaaaagtttgtgctgttaatttaatggggttgggagagtgaacaagttgttttcatcaaacaattctagagttttggagtggggtgcttaggaacgtcatgttttctgacattgtgacttactcctgttgagctgctcttcccgaagcactgaggcaggagtgctctccacccaacaaactgacctcccagttaacattccttagcaatgcgagtcaaagaagtgcttttaagtgtctctgatttttaacacatcactctgcaggtcagtgtctatctggaaatttctacgtgagaggtgatggaaccagagtttacttcttcacacaaggtatgaaacacccatctttttacactaaaagtccccagtaccagatgagatggtcttcaaggcacgttcagaaggaaaactatctggtccctcctgccttttaggcaggctgtttcctgcggttccctgctgctcacaccctcttccaccctgggctaggctacccatggcagccaggcactggggcccccaggcagccctggcttgtccatgccttcagtcctgctctgctctccctgtctgccactgtccaaaatgggaagcctgcccactctgcaaggctcatctccagtccagcctgtttcaccctctacacggggttgtgctttggtgtgcccgggtcagggtgaaccctgggttctaggggtgctgggaactgctctcctctgcaactggcctatccacaggcttcatccttcacctgggccttccaaattctccgttcctgggcccttttcagggtcaccttctttgagcctttggttaagatgatgaaaccactttcctaaaacaattgctttgacatacatagatatttttgcataaattttaaggtgttcatagagcctaaaggccaaatataaaccaaaggtttttaaaaaagaaaaaaccgcggcccatacgcagtggcttcccctacctaaacatgaacttactgttaccaagccaccactgcatttataaccaaatggccatgtaaaaaacatgacagcaacttcccagagccccttttaacaaggacttagtagataaaaatgccttttcttgaggggaaaaatgcataaacatcttttattttccacactagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctcaaaaaaaaaaaagaaaagaattttcactttttgcaaaattatcttttttaatgcacccttaagtgtttgacacaaaaggaattgagggaacttcttaattttaaccacatcatcacttcacttctgaatgtgatcattatcagtgttagatgc

SEQ ID NO: 9359 - DNA, 9474 bp, Homo sapiens
ttttttttttttttttttttttttttttgagacaggatttctgtcacccaagctggaatgcagtggtgccatcacagctcactgtagcttcaaccttccagggttcaggtgatcctcccacctcagcctcccaagtagctgggacaacaggcgtgtgccaccacccctgctaatttttgtcttttttgtagaaatggggttttgccatgttgcccaggccagggttcttaatatttttttaatgtatctgataaagccttaggatcatttctcaggctaatgtatttttcatttgttttctttttatatataacagctttattgagatataaagtgtgtaatacagtggtttttttgtttggttggttttttgttttgttttggtttggttttgaggtggcatcttgccctgtcgcccgggctggagtgcagtggcacgatcttggctcactgcaacctctgcctcccagtttcaagcgattctcctgcctcagcctcctgagtagctgggattacaagcgcccgccaccacacccagctaatttttgtatttttaggattcactgtgttggccaggctggtctcgaactcctgacctcgtgatctgcctgcctcggcctgccaaagtgctgggattacaggcgtgagccaccgcacccggctgtaatacagtggttttaagttaattcacagagttgtgcagccatcactgcagtcaacttcaggacattttcatcaccccaaaaagaatccctatacccattagcagtcactccccatttcccaatttcccccaatctctagccctaagcaaccactactctacaaatgcacaaatctctatatagatttatcttgggctaattttaagtatatgaagtaaaatagagaaaatcaattattttgaaatacagttctatcctcagagcccaattaaggactctgattttaaaaataatactcttagcccttcatattcaccttttctgcatccgaggattcaagcaaccatggattgaaaataaatagtataggccaggcgcagtggcccatgcctataatcccagcactttggaaggccaaggagataggatcacctgagcccaggagttcaagacgagcctgaacaacatagtgagaccccgtctctacaaaaaaattagccgcctggtgctgcggctcacgcctgtaatcccagcactttgggaggccgagacgggcagatcacaaggtcaggagatggagaccatcctggctaacacagtgaaaccccgtctccactcaaaatacaaaaaaaaattagccagtcgtggtggcaggcacctgtagtcccagctactcgggaggctgaggcaggagaatggcatgaacccaggaggcggagcttgcagtgagcggagatcgcaccactgcactccagcctgggcgacagagtgagactccgtctcaaaaaaaaaaaaaaaattgccaagcatgctggcatgcacgtgtagtctcagctactttggaggctgaggccagaggattggttggggctgcagtgagccatgatcacaccactgtactccaggtgacagagcaagaccctgtctcaaaaatcaataaaacaacaatttttaaaactataactgtttacatagcatttatattaggcgttatagatgatttaatgtatgcaggaggatgtgtgtgggttgtatgcaaatgctacacccgacaccattgtgtaagagacttgagctggataccaagggacaactatatgacctgtagaaaacttaaagaaaagcacaggccgggcgtggtggctcactcttgtaatcccagcagtttgagaggccaaggtgggtagatcacctgaggtcaggagttcgagcccagcctggccaacatggcgaaaccccatctttactaaaaatacaaaaattaaccaggcgtggtggtgggtgcctgtaatcccagctactcaggaagctaaggcaggaaaatggcttggacccaggagtggaggttgcagtgagccaagaccacgctattgcactccagcctgggtgacaaaagcaaaactccgtctcaaaaaaaaaagaaaagcacaaagaggccaggcacagtggctcatgcctgtaatctgaacactttgggaagccaaggtgggcagattacttaaggtcaggagttcaagaccaacctagtcaacatggtgaaaccctgtctctcctaaaaatacaaaaattaacaaggcatggtggtgggcacctgtagtcccagctactcaggaggctgaggtgggagaatcacttcaacctgggaggcagaggctgcagtgagctgagattgtcccactgtactccagcctgggtgacacagccaagacctcgtgtctcacaaaaaaaaaaagaaaaacatgaagaagaaaacaacgcttgccaggcgcggtggctcacccctgaaattccagcaccttgggaggccgaggcaggtggatcacctgaggtcaggagtttgagactagcctggccaacatggtgaaaccccgtctctactaaaaatacaaaaattagctgggtgtggtggtgcgcacctgtaatccgagctacttgaggggctgaggtaggaggatcacttgaacccaggaggcaaagactgcaatgagtcttttagaaagcagaagctgagtctgatagaacttagcccgtgaccttaatgggtactcggcagatgcagctgcctggctgattcgagaacaggacaggcatggaccctgctttcggagcagtgctgtggaatagaactttgtgcagtgatggaaatgttctgcatcttcactctcccttatggtgggcactagccacgtgtgaaacgtatctaatgggactgagaaactgaatttttaatttaagtagccacaggtagctagtgattaccatagcaaatgctgcagttccccgggtttttagtcttgattatacctcccagaagttgtctgctccaaaggtcaacagttcagcaggaagcagagcccatgcctttgagaggctggaggtattgcatactcccaaaaatcccagcgtctcactcaaattatgagcccaacagtgcagaagagctctgggctgttgtttctaaaacgcaagcatacagccttcctcctctcccatttttatttagacctgtactaacaaaaagaattctggcattacaaattgttttgtattttgatgccttcagaataaatatataatgtgcttcataattggaagcaattttgatggttttaaaatcaacattttttgtgttgctaccttgtgctgagacttgtgctagatagtgaggataccaagaaaaataagcacagggattttgtggtgttcatctttatctcctcagcatctaagataatacacaatgcatagtgggctctcagtagtgtttggtgaactaataagcgaaagatgtaatcgccgctgtgaaagcactcactcactatgtggtgggggccaacagacaggtacagatgtgttcctggtgtggagaaagtgccaaggtggctcagcgaagaaaaaagaattcttgtggtgctatcaagcaaggcttcatttgagggaaaagtaggatttctgtaggtggaaaaagagaagacattgatttgaaactccctggttgttttataaacttcatattagctatgtccacagagcctccaaaaggatataattcaaaaaggattttaaccaaaatgaaatatgttgtgactaatagatacagtttatttgaatgaatgatagtttttcccatttgatattttaactgtgctacacaagaatgagagtagacatagctcgatttgtagtctcattgttttgtcttttctgcccatttcagtgacccaggactctttgtttattgctgtgatttttcttccacagctatagaactggtccaggtgagtacgatgggaaattacctattggtaatttccactgattaaagggaaaaggttctcctaaaaatcaaggtctctggctgtgttcttatacggtctgtgttcttacggtctaaaagtaaaagatttactgataacgagcataccttgttttattgcagttcactttatcacactgtacagatgtcatatctgttcatatattgaaagtctgtggcaaccctgcatcaagcaagcctaccagtgccgtttctccaccaccatatgctcacttagtgtctgtgtgtcatgctttggtgattctcagaatatttcagacttttttactattatgtatgttatagtgtgtgacgttactgttgtacttggtttggggttccacaaatcacatctgtgtaagacggtcaacttaataaatgcatgtgttgtgactgccccaccaacctgccattccatttctctccctctcctcaggtctccttgttctctaagacacaatattgcaattaggccacttcatactctacagtgtcctctgtgtgctcaagtgaaaggaagagtttcaccacgttgcccaggctggtctcgaatgatagcttacacttgtgttgtaattattaaatttaatacacaattgcataaactaatgaaatacgattgcatgccggtgcggtgactcatgcctgtaatgccagcactttgggaggccagggtgggtggatcacgaggtcaggagttcaagaccagcctgaccaagtgaaaccccgtctctactaaaaatacaaaaaaattagccgggctaaaaatacaaaaaatggcacatacctgtaatttcagctactcaggaggctaaggcaggaggagaatcacttaaactcaggaggcggaggttgcagtgagctgagatcgcgccactgcactccagctagacgacagagcgagactccatctcaaaaaaataaaaataaagataaaaatacgttattggttggccacaatggcttaacgcctgtcatcccaacactttgggaggctgaggcagacagatcacttgagatcaggagttcaagactggcctaggcaacatggtgaaaccccatctctactaaagaaaaatacaagaaattatccaggcatggtggtgggcacctgtagtcacagctactcaaaaggctgaagcaggagaattgcttgaactggggaggcaaaggttgcagtgagccaagatcgtgccactgcactccagtctgggtgacagagtgagactccatctcaaaaaaaaaaaagggagaaagaaaaaaaatagtttattgctaaaacatattaataatcatctaaaccttcagtaagttgtaatctttgctagtggagggtcttgccttgatattgatggctgctgactgatcagggtggtgattgccaagggctggggtagtggttgctaagggctggggtgactggcaatttctttttttttttttttttgagacggagtctcgctctgtcgcccaggctggactgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggccggcaatttcttaaaataaggtaacaatgaagtttaccatatcaattggctcttcctttcatgaaagatttctctgtagcatgcgatgctgataggattttgcccacagtagagcttctttcaaattgaagtccattctctcaaaccctgctgctgctttatcaactaagtttgatgccatttcaaaacaaaaaacctttcttgccatttcaaaacaatgttcatagcatcttttctggagtagatttgatctcaataaaccactttctttgcccaaccgtaagaagcaactccttatagataaggatgctggttgaaagaaagaaagaaagaaagaataagactaaaaaagaagaagcaacaagattgcagcaattcagttacatcttcaggcttcacttttttttttttttttttgagacagggtctcactgtgttgtccaggctgaagtagagtgacacaatcatagcccactgtagccttgaattttgggctcaggcgaacctgatgagatgattccattggggttctttgagttacaagtaacagaaacatctagacaaactcaaagcaataaagtagaatgtcatagaacctaagggcacaaaatacagccccaagttcctggtatcttacctctcattgtccagggcccatttgttttttccctctttgcataccagttttctctagtcagtatttcctagttttgcacgtggccccaacgtgcttgcttcttccagtcccttacaagctcaccctgttcaggggttcatggtgcctcactaaaatgattgtgtcccagttctgaagtccctggaaagtctagttaacacaacctagctgataaatacagcagccctgtttgaatcagctttggccaatgagaaacaaactcacatatttggagaagatggacattgagggtagatgccttaaaatgtatctgttatggctgggtgcagtggctcacacctgtcatcccagcactttgggaggccacggccagcggatcatgaggtcaggagttcgataccagcctgaccaatatggtgaaaccccgtctctactaaaaatatgaaatttagctgggtatggtggcacgcacctgtagtcccagctacttgggaggctgaagaatcgcttgaacccaggaggcagaggttgcagtgagccgagatcgtgccactgcactccagcctgggtgacagagcaagactccatctcaaaaaaaaaaaaaaaaaaatgtgtctgttacaattggccaggcgtggtggccagcactttgggaggctgaggtgggcagatcacttgaggtcaggagttcaagaccagcctggccaacatggtgaaaccctgtctctactttaaaaaacacaaaaactaggccgggtgcagtggttcatgcctgtaatcccagcactttgggaggctaagacgggcagatcatctgaggtcaagagttccagaccagcctggccaatatggtgaaactccatctctactaaatacaaaaattagccaggtatggtggtaggtgcctgtagtcccagctactcgggaggctgaggcaggagaatcgcttgaacctgggaggcagaggttgtagtgagccaagatcacgccattgcactccagcctgggctacaagagcgaaactctatctcaaaaaaaaaaaaaatacaaaaactagcaggacgtggtggcatgcacctgtaatcccagctactggggaggctgaggcaggagaattgcttgaacctgggaaagcagaggttgcagtgagctgagatcgcaccactccagcctgggcaacagaacaagactctgtctcaaaaaaaaaaaaaaaaaagggtctgtcacaattatgtataatgctgttagggcagattaggaattggtagtgccatgcttttagaattattcatgcagttaaagaccaaatgaatattgaagcctatctttacttcagtttttgataacaaagtaaattttctacatctacagaaatagattttcctgaagaattctatggtttgtgtaatattttctagttgggagttgttttgaatcgtgtactttgttgtttgttttgagacagggtctcagtcactcaggctggagtgcagtggtacaatcaagctgactgcagccttgatctcctgggctcaagtgattctcccacctcctgtgtaactgggactacgggcacatgccaccacacctggctaatttttttttttttttgagatggagtctagctctgtcgcccaggctggagtgcagtggcgtgatctcggctcgctgcaacctccgcctcccaggttcaagcgattctcctgcctcagcctccagagtagctgggattacaggcgggtgccactgcacccagctaattttttgtatttttagtagagacggggtttcaccatgttggccaggctggttttgaactcctgacctcaggtaatccgcccacctcgacctcccaaagtgctaggattacaggcctgcacctggcatttttttattttttgtagagatgaagtctcactatgttgcctagctggtctcaaactcctgggctcaagtgatcctcctgcctcagcctcccagggtgctgggattctaggcgtgatccactgtgcctagcagatcgtgcttttggtttgtttgtttgtttgtttgtttgtttgtttttgtttttgagacggagtctccctctgttgcccaggctggagtgcagtggtgcgatctcggctcactgcaagctccgcctcccgggttcacgccattctcctgcctcagcctcccgagtagctgggactacaggcacctgccaccacacccggctaattttttgtatttttagtggagacggggtttcaccatgttagctaggatggtctccatctcctgacctcatgatctgcgcgcctcggcctcccaaagtgctaggattacaggcgtgagccactgcgtgcttatttaaagtatgtgctgtctctctccttatgaatgtttttttttttccctgttggtcactcattttcatgatcgttttccaattcttagatctgacttcatgcatgagaagtacagaaagtacacaagaataaagaataaaagtaggggagtcaggaatgttctattttaaacgcaactattagattcctcactgtctcccttcaattattcctgatctttactctttgagtcctccctgaaataacatgctattagattgatgcaaaagtaattgtcgtttttgccattacttttttttttttcttttctttttttagacggagtttcactcttattgcccaggctggagtgcaatggtacaatctcggctcactacaacctctgcctcctgggttcaagcgattctcctgcctcagcctcccgagtagctgggattataggcatgcgccaccacacccagctaattttgtatttttagtagagatggggtttctccatgttggtcaggctgctctcgaactcctgatctcaggtggtcctcccgccttggcctcccaaagtgctgggattacaggcatgagccaccacatccttgccattactttcaatagcaaaaaccacaattactttttcaccaatctatataatgattagaaatatatcccctactctggagggtgaggcaagtgatcctatcgcgtgaacccaacagtttgaggccagcctgggcaacatggggagattttgcctcaagaaaaaaaagaaaaaagaaataga

SEQ ID NO: 9360 - DNA, 4634 bp, Homo sapiens
acgacctgtgtgatgaagagaagagttacccagtgcccaagggagtcttgatattatcattctcatatttgttctttcagcaattgttccagacaagtaagtttgggtcccttggctggtagtgtcacaaaaaggaagctttggtgagggacctttttttttaaaataggttcttgctctgtcagcccaggctggagtgcagtggcacgatcatggctcactgcagccttaacctcttgggcttaaatgatcctccctcctcagcttcccaagtaggtgggaccacaggcacgtgccaccagtcctggccaatttttgtgtttttagcagagatggggttttgccatgttgcccagactggtcttgaattcctgggctcaagcgatcctcccaccttggcctcccaaagtgctgggattataggtgtgagccaccatgcccagcctggcgagggaccttgatattagagttgggctcaaagtaaaaagagttttgtttatgttctgatagacacaaagaagccacaccatttgtagtgatgtgagcatctcagccattttcctaaatttgtcttgatgtccaacttctgttctggcctcgaaacttctgcagtagttggttcttcatttccttgttgtggctcaacattgggaaagaatgggaaatcagtctctaatgagtatgtggggaaattcctattgatagtctcatcacatgccgttttagaactgtgaactgtgggtgtcacagctcttaggtaatgtctcattattggatttttattttattttattttatttttttgagatggagtcttgccctgtcgcctgggctggaatgcaatggcgtgatctaggctcattgcaacctccacctccccggttcacacaattctcctgcctcaacctcccgagtagctgggattacaggcacctgctaccatgcccagctaatttttgtatttttagtagatgcggggtttcaccatgttggccaggctggtcttaaactcctgaccttgtaatctgcttgcctcaaccttgcaaaatgctgggattacaggcatgagccactatgctggccttttttttttttttgaagacggagtcttgctctgttgccccggctggggtgcagtgatgagatcttggctcactgcaacctccacctcccgggttcaaccaattctcctgcctcagcctcccaagcagctgggattacaggtgtacgccaccatgcctggctaatttttgtattttttttttttagtagagatggtgtttcaccatgttggccaggctggtctcaaactcctgacctcatgacctcatgatccgcccgccacggcctcccaaagtgctggaattacaggcgtgagccaccacgcccagcctattggccttttaaatgctttaaataaaacaaccttattagcaacatgaaatttacattgaaccttaactaaggtgttctctgatgcttacagtgttttaggaaagtgtgatacagaattctataaaatcagattcagattaaaggaaagtcaaatgctatatcctaaaatacaccattaaaacttcatatgcataggtaaccagtggtcctgtgacactaccttctcttttttttttctgagatggagtctcactctgttgcccaggctggagtgcagtggtgagatttcagttcactgcaacctctgcctccaaggttaaagcgattctcctgcctcagcctcccgagcagctgggattacagacaagcaccaccacacctggctaatattttttgtatttttagtagagacggggtttcactatgttggccaggctggtcttgaactccttacctcaagttatccacccacctcggcatcccaaagtgctgggattacaggcatgagccactgcaacctgaccaaaactaccttctcaaggaagcagagtcagatggtggctcagagattcagataccattgactaattccatggaagcccttggcactgccagagtgcagtgagtctggacaggctgggggttggcacatgttagggtaaactatacccatgaaatcatgagattagagacttcaaacatctcctcattctgtgtcatcagagtcctgcaaaggatgattaagtaagttagtgttaaaggtcaaggtaagctggtgttaggaagccagattacatgactagagactgcagggaccagtgattgagatcctggtttatctcccagagtccaaggacccctcactggctgcacaggataggagctttgggtgattgaccttcctctagaaggccacacttcctctagaagggtactgaagtcatccaacctgagaggatgagtgtgaaataaaggcatatgcaggataacccaaaaggcctaccatggttttaaactttaataattgcagaggttgaccaggcacagtggctcacgcctataatcccaccactttgggaggctgaggtgggaggagtgcttgaagccaggagctcaagaccagcttgggcaacaaagcaggaccgttatctctactaaaaataaaaataaaaaaatttagccaggtgcatatctgtagtcccagctactcagaaggctgaggcaggagtatggcttaagcccaggagtttgaggctgcagtgaagtgagctacgatcacaccactgcactgcagcctgggtgacagagtgagaccctgtctcaaaaaaaacctatgaccttagaagtttcaatgctacaaactttttaaaaattgacatggactaaaacaaattattaaaatttaaaattcaagccagacacagtggcacacacttttagtcccagctacctagagactgaggcaggaggatcacttgagcccaagagtccagccgaggcaacatagcatagcaggaccccagctgttttttgtttgtttgtttgttttctgagatggagtttcactcttgttgcccaggctggagtgcagtgctatggtcttggctcactgcaatctccgcctcccaggttcaagcgattctcctgcctcagcctcccaagtagctaggattacaggtgcctgccaccatccctggctaatttttttgtatttttagtagagacagggtttcaccatgttggccaggctggtctcgaactcctgacctcaggtgatctgcctgccttggccgtttttttgttttttggttttttttaagagggaaacattcattatgcaaaatttaaatagactttgaaatttttttggtgaagtttgtagcatttagacttctgaagttatgaaagcttcaacctgcaccaagacttttgaagaacactgcatatggaaaacacagacctaagtgtaaaaccctctgtctgttatactcatttgcatactgattgtattgtaagttcttgaggacaagtcttcatttaacaaacagaaagatacagcccctacattgaaagagctcaggtctaatgatgcaggcagataagtcacctagcagaacccactggatgctcaggattcagctcagccacaggcgcacagggcaaagatggctatctaggacagtggggaagtgagccagatagagagcagagaacttttgtttgtttgtttgttttttggagacaaagtctcagttactctgcggcccaggccggagggcagtggtgcaatcttggctcactgcaacctccacctcccaggttccagaaattctcctgcctcagcctcctgagtgtctgggattacaggcacacgccaccacacctggctactttttgtatttttagtagagatggggtttaaccattttggccaggctggtctcaaactcctgacctcatgtgatccacctgcctcagcctcccaaagtgctggtattacaagcatgagccaccgcacccggccaggagcagggaactttcttacggcagaagcgggctgtcctcgggccccttcaggctgaaggcagtggatcgaggccacagctgtgagcaggcagctaatgtccttcagttctaactgaagcaagagtagaggagcttagatctcagacttggtgtgtcagttgaggaagtccactggctttttgggatatgctacagggaaagagaaccccgtctttaaggagacctgattgaccgtcattccctgctgctccacaggatgcagaaggctatcaacaggctgagcaggcttctgaaacctggcgggatgatgcttctgcgagattacggccgctatgacatggctcagcttcggtttaaaaaaggtattttgaaagtgctgaatcctaaccactagagatcatgtcctttgcagggacatggatgaagctggaaatcatcattctcagcaaactaacacaagaacagaaaaccaaacaccactttttctcactcataagtgggagttgaacaatgagaacacatggacacggggcggggggcatcacacactggggtctgtctgggggtgagggagctgggagagggatagcattagcagaaatacctaatgtagatgacgggttgatgggtgcagcaaacctccatggcacatgtatacatatgtaataaacctgcacgttctgcacatgtaccccagaacttaaagtataatt

SEQ ID NO: 9361 - DNA, 168 bp, Homo sapiens
cttggctaatttttttttttttttttttttttgcgacggagtctagctctgtcgcccaggctggagtgcagtggcgtgatcttggctcactgcaacctccgcctcccaggttcaagcgattctcctgcctcagcctccagagtagctgggattacaggcgggtgccac

SEQ ID NO: 9362 - DNA, 687 bp, Homo sapiens
tcagtggtgcaatgatagctcattatcacctcaaacttctggctcaagccatccctccgcctcagcctcctgagtagctaggactgcaggtgggcaccatcatgcctagctaattgttagatcctttttttttatgttctgcattttttcagttatttttacatatttctctcttgatccatgcagttataggatatatccttaattttagaaagtaaggacttttcgaccaggcgtggcggctcatgcctataatcccagcactttgggaggccgaggtgggcagatcacttgaggtcaggagttccagtccagcctggctaacatagtgaaaccccgtctccactaaaaaataaaaaatcagcccggcatggctgtgggcgcctgtaatcccagctactcaggaggctgaagtagaattgcttgaacctgggaggcagaggttgcagtgagccgagatggtgccattgcactccagcctgggtgacaagagcgaaactgcatctcagaaacaaagatgcctagctttcaccttgttgatgtttttctaaattttggaataataaatttatataggaatactgcaagaatagtccatttttttctgatgtcccaacatcaccaaatgtatccatcacaagtaggaatacatggaaacattaatgccagccactaaccattcatgtt

SEQ ID NO: 9363 - DNA, 382 bp, Homo sapiens
cacaaggtcaggagatggagaccatcctggctaacacagtgaaaccccgtctccactcaaaatacaaaaaaaaattagccgggcatggtggcaggcacctgtagtcccagctacttgggaggctgaggcaggagaatggcgtgaacctgggaggcggagcttgcagtgagcggagattgcaccactacactccagcctgggtgacagagtgagactccgtctcaaaaaaaaaaaaattgccaagcatgctggcatgcacctgtagtctcagctactttggaggctgaggccagaggattggttggggctgcagtgagccatgatcacacacaccactgtactccaggtgacagagcaagaccctgtctcaaaaatcaatcaa

SEQ ID NO: 9364 - DNA, 106 bp, Homo sapiens
atcccagcactttgagaggctgaggcgggtggatcacgaggtcaggagattgagaccatcctggctaacacggtgaaaccccgtctgtactaaaaaatagaaaaaa

SEQ ID NO: 9365 - DNA, 44161 bp, Homo sapiens
cctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgggtcgtcctttctgcccttgagcccctaacgcagcgccacgccaactaccgcttccccccaggcagacgcttgtgggtggccagagcatcttgactggattcggggacccttggggaccttcttccccgccaggctcgcgaagttaaagttcatctgctgagaacttctaactccacactttcttggttatcttggggactcaacactttgatcaagaacttttttattcctcccgcttaattttgtttgctttgagagagacttgggaactgcaatcgtttggttctccagtccgatctggtagcgttatttttaaaatttatttttattttttattactattttactagtgaagatagatgagctcagagactctcgaggatatagcatgaagttttctctttttgttagatggtgggaaagggactttctgcccagcgattttggtttgagcgggtgttgatgagtactagaaaacggctagtaccactctgcattgtttcatgcattgcaaggaggtaaaaattttttaaaaaattaataacaaagaaaacttaactctgaacctagtaattagaaatgcccagagtctgcacaatgtttggctcatggaaggctctcaataaatacctagtgtttgaacatactggagatattccatatgccttcagataacatggttacccctagaacaaagaacctagtgaagggggtggggtggaaaaaagacaatcactagttagaagagtcacactgtggtctacccaaaccctcttacagcctgtgacttctgcagagtcagtaaaaaatcagctataattttcttgtcaacagaacaaagattaagtcatttgttactaaagaaatacctttttaactgactgtatagcatttcataatcctgaacattgtaacttttttttttttttttttgagaatggagtcttgctctgtcacccaggctgtagttcagtggcgggatctcggctcactgcaacctccgcctcccgggtttaagcgattctcctgcctcagtctcccgagtagctaggattacgggcacatgccaccacgcccggctaatattttgtatttttagtagagacgggtttcactgtgttagccaggatggtctccatctcctgacctcgtgatccgcccgcctcggcctcccaaagtactgggattacaggcgggagtcaccacgcctggccttttttttttttttttttttaaatttgagtttgaaggttggggcagaaagagatcaggatttgcactgccctgtcacatgcaatctcccatgtcagagcattactctcaaacatggaaaaactttaaaatacacaactctccagatggacacagctgaatcattttcaggaaggctctgcctataaaattacctttggccttaattcagtaattaaaggcacccacaggtctgagccctcatctatgaaggttaaacgtatcattcctatcagcactaattggttttataggatacagacctctagtttgctgaataaactttggaaggattcagattatgaggttctaaactgtagagcctttgaggagaaaggtaccccatttcttctccgaatagatcattttgtgtcttctcctgggcttagcacattgtcttccttaggatctgatagtctgtttatttatctttttgttgtcataccttttattcttgcatttcccacttttgactagcattttgccttttctccgtttctggaagcctgtaattttcaacattccccatttctccttttgttcagtggaaaaatttcttcagtgttgggatgctctggaaaggtactgtagttttgggggtctccctgcctgctgggctgcatagcatatctctcttttttgagacaaggtctcactgtgttgcccaggttggaatgcagttgtgcaatcatagctcactgcagcctccaactcctgggctcaagcaatccttccacctcagcttcagccgctcaaatagctgggactacaggcaatgcaccaccataaccagcgaatttttaaaaattatttttgtagagacagggtctcactatgttgcccaaactagtcttgaagttctgacctcagccccgcaaagtgctaggattacaggcgtgagccactgcttctgcttgcattatctcaaatttttagagcctaacttcacagtcttgcctcggagcaggaactgtttgaggcaacaagatggagcctctggtttcttcactaggcagactgtgctcaaactgggtagcatgaaaggaaagcagcacaattaaaattgaaattgggggattctttcccctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggttagttttgttggaagttggatttacattttcaatgatttgatatctgaaacctcttctgattagtagaccctcagaattttaattttagattaagaagatgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttccttattactaccactttatttctaaatgttgccatagtcatttggctttgttctaaatctgtaggaaagatagagagattacacattttgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatgggagttgtggtttgtcacaaggttatggcggtccaagcaagtttacaatattttttagaataataactcccagaaatatttttaaaataaggacctttctttaatatggaaaaaaaaaagatgaaatagagaggaagaggttgcctttcctcaactggatttgctggtgtgatatgcagctggtggaaaccagtttgtccatgctagctgttgatggccaccagtccactgaattagtggaaacccatgcttaaccagttgttaactatttttagtatcatttccagatgctacgcattttttttgtaaaaaacatacttacaatagtatctatataaatttttaaaattgtaatgtatatgtggtatatttaacctgaaaataatctttggtgtatacgttgatgagcctaggcctttgcagacctcttacagttactctgtcacagcccttcaaaggttctttgacttcagattaagaatcaattgcatgtggaatgcatgtgcaaaggaagagatattcaaggcaattgttaccatgtaccataaaccttgtacataattttttgtcattttcttttcctctgtctctatcccttcttctttgacacacaatagacacctagtcaatttattacaaaaaaaatgaatgaatgaagtggaattcagttgggaaataggttaaataaattatttaggagatgaggaataggtaaaaagagacaagtacatagtttattcttttgacttagaaaacttttgattcttaaattctgcagaattggagaaactggtggggaaacttctaaaatcattatttaattaccagagatgtaatagatatagacaaaagcagttttcttcttttattattttttcatcagttagttcttagcttaaatagtagtccaaagctggtagggacagagggaattagctggtggctgaatgaggaattgtatcactttttgtgaatcacggtgtaagcacatttggtgttttgccattgcctaagaacattagtcacattaggtcaatagaaaatcactttttaaagccaaataaagttatatgtgttcccaaccatgagttggaaagaattaatatatatgctgttggagggtagaaccctgcctaatcatatggttctggatggcattgatcgaatccttattctttcattaggaataacaatagaaaaaatactcctgccctactgatttcaggatatgtctattttaaagtgcccatttgacaaaaccattatcagggccatgttttctttttctgcagaaaaatcaaccactctggtcagtagttaggtcttatgacaagcaccataatttccttaggcagagtagaatataataggatacttctttttgaaacttaatataatcaggtagttccagataaacatagcttgcaaagtgataaaataccatgttattttagtaaatccaattgcaagagtgatgggaaacagagtttaaaaacttaagaaagatattaagatggagttgactttgaataataaagtcatccactgttgatgggtgacatttattaatacagaaagtttacagattttaccataagcatcagggtatttcctgcagctggggaaaccgtgcttgaaaggatgcgtaactcaaggaaaacacaagcccatgtaataagtattgcatgtgagaattgttcctatagaattagaaagcatcttttacattaaaatttatttttgtaaaaagagaaaacatcaaaacttgagtagtatttgctattcaaagagtcttacataaacgaaaacatactcaacctactgccattacagaaatatttgacaaattcttgccatgcttacctgccatcgttgttgttatcctacaaatcaattggattttcacgcctctccactgactggaaccctacaacttgcttccttttatcctctttatatatgcttcagatatgcttgaagtagattgtttcttattgttcttgctgctcgagtttgttgagtagttggtacatgcagagtatttgtatgttatgacatatataggttttgtccatggttcctggctcataactcactcccaagacccttgttacagaaaccagaatctctctctctgatcttctcctaccctcctttcatctgcccactgcagaactctaatctgattatggtttctaagaccctcataccagagagtattctgccccataccatagcagaaggaacactgcacagagacaccaagaagaatctgaacagacaggccttgttaggtttagatcatgtccttataacctaattatattttaacatggttatccatgctttaatcatgtgtattcaatgaacgctccataaaagcccaagaagaacagatttgagggaattctgaagcgctaaacatgtagggtctgacaggaaggtgaagaagaactcatcatgctggaagggtggtccaccctaactccgcagggacagaagctcctgtgtctgggacccttccagaacttgctctatgtatctcttcaagtgcctgtgtatttatatcctttcaaatatcctttgtaataaatcataaacatgtttccctgagtttttatgccactctgtcaaattaattgaacccaaagagggggttatgggaaccccaatttgaagccagtccatcagaagttctggaggcctggacttgagactggtgtctaaagtgggcaggcagtcttggggactaagccctcaacctacgggatctgaaactgtctcctggtaggtagcattggagttgtactggagggcactgagctggtgtctgctgcagaattgattgcttgcttgctggtggggagaacttcctacatattttggggtcaccgaagtcttttgtattgattgttgttgctgactgagaataggaaaaagcacgttgagtagtttttccacaccacagcattcttttaggctcctgcttttaccttctgcttccctcagcatcctgcatctcaccaggagagacacagcttctttgccattctcggcattccacttcggaatcaatcagaatagctcctattgctagaaacttgctttattaagttctgtttattcagggcttatctgaaagagaaacattttttatgatttgagatttctaagccattttaaaacttggttttaacagcttgagaaattgggggtatagtagggatggagatacatatatttggatgtgacttcaagctagataaaagtttggaaggaataaaagtttgacatctaaagtttttgcatagtttgagttgagcaggaggtactaggtatgtttttaaaatatttttttcagccaggcacggtgactcatacctgtaatcccagcactttgggaggccgagacaggcgatcacctgaggtcaggcgttcgagaccagtctggccaacatgaagaaaccccgtctctactaaaaatacaaaaattagctgggtgcggtgacacatgcctgtaatcccagctattcaggaggctgaggcaggagaattgcttgaacccaggaggcagaggttgcagtgagccgagatcacaccattgcactccagcctgggtgtctcaaaataataataataataaaaaaatgaaagattttttcttactcagcatcctccaggcattttattatctgagcactttatgggagttgcatattacatttagggcccactcaggtgggtgggtatctaagcatttgaaataaccttatgtaaactaataaggagtaatcaggcctgtggcaagatggaaacagtcttagaggcattcaaattcaaatttcctttaaaacactgggctggccaaaacaaaagacaatactatctacaggccagtttctaagattatcagattttagtagcatttaccatttcattgtacttggcacactttagcaaatttgcacttcttaaaagtacctgcaggcaatctcctatataaaaacacaatgcaggctagcttggctcctgcctttaattccagcactttgagaagttggagactagcgtggccaacgtggtgaaacctcatctccactaaaaatacaaaaattagccaggcatagcagcgcacgcctgtagtcccagttacttgggaggccgaggcagtagaatcacttgaacgctggagacagagcatggagtgagctgagattgcaccactgcactccatcctgggtgacagcgtgagactctgtctccaaacaaaacaaaacacacacacacacaatgtaacaacacgaaacagaatactgtgaaaatgcttaattatgtctgactttacatgatggctggatatgtgattattttttcttctttatgctcttatgtactttgttcatttttaatgatgatcatgtataaagctcctctgtgtagcattctctccaccaaattgcccagagacaggaagtcctgtaaaacaaactaagctccaaaaaatgacctcctgttgaataggcttttttttttttttttttttttttttttgaaatggagtctagctctgtctcccaggccctcgctccttccacctcctgggtttaagagattgtccttcctcagcctccagagtagattggattacaggtgcccgccatcacgcccagctaatttttgtatttttagtagagatggggtttcaccatgttgaccagactggtcttgaactcctgaccccaagtgatccgcccgcctggacctccccaagtgctgggattacaggtgtgagccaccacgcccagcctgaataggctttctaacctactgtttctcattttactttctctgaggcagtaaaagaaactgactctaaaagggagcagtagagaaggaactcagattttattttgaagattaagctactcaagggctgaggaaatatgtagaggggaagtagactcattatggctggaaattttatttggtgatagtgaagcaaatcttagggctttctaattgagctcttgtttgaaaggctccaatcttaatagaactataagctaaaaaaaatgaccatcagtgtttctaaagcaagttgctactcaaaacaagaacactttgggaggctggggctggtggatcacctgaggtcagaagatggagtccagcctcaacatggtgaaacccctctatactaaaaatacaaaaagtagccgggtgtggtggtgcacgcctatagtctcagccacctgggaggctggggcagaagaatcgcttgaacccgggaggtggaggttgcagtgagctgacattgtgccactgcatttcagcctgggtgacagagtgagactctgtctcaaaaacaaaacaaacagaaacaagaactctatgttgagaaatccatactagagggtttaatttctcactttgtgtgctagtgattaataaatttcaagcttatcacacagccagaaatgtcgcctgtgtttctacaataaaagatttgggaatattgtgacattttttcactgagccttctgggttcattattaagatataacaattttagaagacttattgagataggtatactttttaaaatttggattcaatatatcaagctcagcattttgtcttttttttgttttgttttaaacaactttgggtttacttgtaagagtatttcagtggaggaaaagtatcagaagtttagcactgagtgcctgcctaactattttatgtcttctttcatgatgatgcttaatctcaacataatgactcagtttaccattgtaaactctttgtaggatgtcactgattttatcagtcatttgttcatgcagctgggaactgtggggatatatgatttgccacatctgaggaacaaactgggtgagctccattgaaaaatttctaactttcttattaaaagcaagcttcctcacttcctgatggcttatgcaaattaatgcctatttattcatcagagggtgactggagagattatggttttcttatgaatttcttgcttgagcctgcttgtctgctgtttctaagttgtctgcactattttatgtgagtaattttctactttattatgttctgttttcacatgtcaaatcagctctcccaagaatgctacttgtaacctaagtagacgtgaaccgaaaagggtaaagacccagctaaaaaaaaggttgactcaagttcagttcacattcgtaaagtagttaggctgccttaggttgcttattcttttcttgaaaagaatccctcaagagagaaacatgtgaggccacagcagcttagatctgtcttccacagagaaggtggcttttacagagaaattgacatactcatcacttatctgacatgacccagctttgtaaaactggcttctattaaaatagtcttaatagactattcactgaggaggagagaatcttattcactctttacattctcttcacattttcagaatagatgtttaaatcattgctcacactggatccataaatgtctaaaatgttgatgaagaaataggtgattagagagtaaaattaatagagacttacccttccttgcattttaacataatattctttccccttttccttcctctgttacttggctcttaaataccagaagtgagatatgaaaaagggaactgggaacaagtattgaaagcaccataggtttatcttatattagcattttccaaactttataatgaaccagcagtgacccacacatctgccaggtaggaattgctcatcagttgtgtcgcgttatcttgttaagcttcagcaatgttccatacagccactaataacagatcaaagtgagcattagggttgaaattagtaagctgtttcttctcagttctttctggtagttgaataaatatagaatgtattaaatagttttctttatttcagaacttctcagagtctgtaatatattgtatggtggtagcttaggaggaagatgcaataggaaacttttcccagataggttcactattttttttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcagaaacatattcgtttttttcagtggcagttaccttcagatgcatgtgcttctaaagcatgttggttgcatgtgcagtacatgttgcttaagcatttagcttcagaatggcatctttcctgtgaatgtcttaacatttacaaaaatataccaggatctcaaatatcagtgctggtatttttttttttttttacttaaagaaactgatatgattaaatattaagagacaatatgatccttgttggcttgtaaccctagtttttattgtcttgtagttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgatttttttctaagattgtcaggatttgaagtgtatgttttgttttattcacagcgtaaattttattcacagtttaactgtctgcctgagtgtctttcctttctctaattaccttgaggaacccaagagcctgttgtaaggagaaaataaggcccttggatctcttgagattcacagatataagttattgaagggaagatggtcctatggaggacatatttaaagaagggaaaaaagaggctttctcagatatgtcagactgctatagtatacttctacagattatagacctccagtacctctggccagaaagatggtatcgtaaacaccctattttttttcttttcttttttcattaggtacaagctttgtgctaagaagttgacatactataagctacaaaagttctgtaaagtagatataactagtttcattttatagatagagaaaattaatctcttacagtgctaagctcacagagtttctaactgtaaaatgctagaacttgtctttcaagcctaaagacttccttggggctaaatagtgaaaaaagccatttcacaaataagtaaatggtatttagaggcatatttggatttcctggtaaattccagtctgtgagcatcatgaatattagtttaatgttgcatgggctcatgttgaagttttaagagaagaactgccttgaagcttaggtttccttagctattaggctactgactttcttgcctaaaccagggttttttcattgaagaccaaaacttaccttctccttcagtttgtagtttggaaattggtagaagagctttgtaaacttcaaattaagtacaaactaagtgtcatagtcaaatttactaatcttaattacagtattgttcaactgattgctatcttctagctctttcctgccgaataatggtcttgtttcctgctctgttggtttagagctgacttctttcagctttggtaagcctgaaattatggggttatgtttaattcatattgtctgggtggactttcctctcttgcatttctgcttgaatagaagaatttttctctagagagtagtttgtcatccttactctgttgattcagatgactctttgtatgatctgagaggtatactgttctgctattctgagaagaagtatttcagaaagatgaattaagagtacagtggactgctcccacctggaaacttttatctatctcacctctggacctgataaattctttatcactcaggaccttgatgacgctgctctctgaaaccctccccagctctctctattaccgtgagaaacatcagaactttggttcccattgcatatcgcaggtacctctgctttcatgccatgctgtaatggagtgattgggtagcatgttttcatctctttccagattgaaaatctgtatttctccctgtatatcttcaacacctaatgcacatagaactttgtaggtacctggaaaatgcaccacagttttcttttctttttgcagacttttcacaagtattaccaacttacaaagaattaattttgtaggattctagaaagacaaatcaggaatggtgccatatacatcttttttgattccctgctctaaagaatattatcaggttaccttcctgcagagttttaaaagaattgcatatttcaagctgactttcaggatgtaaatataaccaaagcaactgatatgtaaaaaatatattcaatggcattcctagattttcttctagggtgttttattgttttgggttttacatttaagtctttaatccatcttgagttaatttttgtataggtataagaaaggggtccagttttaattttctgcgtatggctagccagttctcccagcaccatttattaaatagggaatcctttccctattgtttgtttttgtacggtttgtcaaagattagatggttgtagatgtgtggtcttatttctgagatcttcattctcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaacgtttttcccttcgtttgtgtcctctctcatttccttgagtagtggtttgtagttctccttgaagagatccttcacttcttctgtattcctagatattttattctctctgtagctattgggaatgggagttcattcatgattttgctctctgcttgccttttgttggtgtatagggatcctggtgacttctgcacattgattttgtatcctgagactttaccgaagttgcttatcagcttaagaagcttttgggctgagatgatggggttttctagatataggatcatgttatcttcaaacaaagacaatttgacttcctctcttcctatttgagtacgctttatttctttctcttgcctgattgccctggccagaactcccaatactatattgaataagaatggtgagagagggcatccttgtcttgtgccagttttcacggggaatgcttccagcttttgcccattcagtatgatattatctgtgggtttctcataaaaagctcttattatttgagatacgttccttcaatacctagtttattgagagtttttaacatgaagcgatgttgaattgtatcgaaggccttttctgtgtctattgagataatcatgtggtttttgtctttagttctgtttatgtgatgaatgacgtttattgatttgcatatgttgaaccggccttgcatcctggggatgaagccaacttgactgtggtagataagcttttggatgtgctgctggatttggtttatcagtatttcattgagattttttgcgtcgaagttcatcagggatattggactgaagttttctttttgttgtcgtatctctgccaggttttggtatcaggatgatgctggcctcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtatttgctgttggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacataggaatgggcaaagattttatgagaaagacaccaaaagcaattacaacaaaagcaaaaattggcaaatgagatctaattaaactaaagagctctgcacagcaaaagaaactactgtcagagtgaacaggcaaccaacagaatgggagaaaattttttcaatctatccatatgacaaaggtctaacatccagaatctacaaggaacttaacaaatttacaagaaaaaaggagccccattaaaaagttggcaaagaacatgaacagacacttcccagaagatattcatgtggccaataaacatgaagaaaagctcaacatcactgaccattagagacgtgcatatcaaaatcacaatgagataccatctcatgtcacaatggtgattattaaaaagtcaaacaacatgctagtgaggttgtagagaaataagaacgcttttacactgttggtgggaatgtcaactaattcaaccactgtggaagacagtgtggtgattcctcaaggatttagaaccagaaatatcattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaaaaggaatgagatcctgtccttttcagggacatggatggagttggaagctgttatcctcagcaaactaatgcaggaacagaaaaccaaccaccacatgttctcacttataagtgggagctgaacaatagaacacatgggcacagggaggggaataacacacactggggccagtcagggggtggggggtcaagctgagggagagcattagaaaaaatagctaatgcattctgggcttaacccatttatgcctagtgttccatttctggaatgctaagcatgtggaagttctttatatcctgctcaaggtcattgccaaggtctgatttttcacattcaacaaattgcaacctctggcataaatgggttaatacctaggtgatgagttgataggtgcaggaaaccaccatggcacatgtttatctatgtaagaaacctgcacatcctacacatgtaccctggaacttaaaaaatttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatatatcatgtggtattgttttattgatgtgttctttgaagtgttacctttgtgtccttagaggctatggtgggccctcaggccatatatgttggatgatttagtggaaaagagattagacttttatattttattctatttatttatttatgttttaatcttgtgtaagcctatagaggccaagatagggctcagagttaaaaacagtgatgttctaactttcaaaactactaaaaacaaaattagctatcaagggaaatcctgagtgttctgactgcaggggttccccaaagcctggaggaccgaagctttgaaatgctgcatggtgtgcctcacctctgttgagtatagtgaggaacatgagctgaggagtggattagatgaactcttaagatttttttccaactttacggtttgagtttatgagtaagtaagtgaggaatgagcccagggactttgactactttgctgtgcagtaaattgctgttttcttagctaattctggagtgtgtattttggttttaatgtaatgtcctttcagcactggaaataaacagatttatgaccctccattttcacatgtaaacttccagttccttcagtaaaatgctggaagttgcttggctgtaaccactgtaactatttcctggcagttttgcattttattacaattcgactttttaaatgcatggttcagtccagttaataggcagaaaactatagctattccttggaactgacatagggaagttggtttctttctgaggaaagatgtgacactctgatggatttggcaaaataccaattcagtaaaatttgcctggttcctttctgacagcaaatggaggtaattgtacgtatatagatttctacagtaaacaaagggcaaaaatggaaacattttttgttttttaatgttgctggaatataatatttccatatttggttaatcatcaaatcattcaactccatgcaaagtactcttttcaaaattacaaatcatcttgatggattagacttggatgtctaaattttttattatgtattctaaattatctataggtacattttgaaaattatatatacatgtatcactgtactacatttgttataaaatgtgaaatattaagcgattaaatactttattaatgtcataaaattgtgccctacccaaaatatattttaagaagatatcatttgaaaataatgtaaaatattcttcattattatgattttgttgccaaaagtaatgttagagtccctgttactgataattttcatgactgtaaattttcaacatttggaaacaaaattttctgatgtgttttaaaatcttaaagaatttcagtagattttgacacatttttgttaaaagtatgaaagtgtcacagctttagaaggatttagaataattatcaattggtattagggatgacaattttaatagacaaattttaactgaaacatttgctttattgatgtctaggactaaaaaaaatattatagtgatggaaccatttcaaaacatctgtttttaaaaacttctgtcaacatgtttgacagaagtcagaatagggtaattataaaaaaactgccattttcttatgtttgcatcattagtatttgcaaatccttgtttctttgcaagtatattttaaactacttgttcattttatgagtgttagcctgattaattcagataagatgctcaagtcagtttaagcaggcagatgtgaaaaagggaatatgctgtgccttaactatcttatagggacttactagcacactgtacataacagatgaacatctgatattagatctgatgggcacaccaatgttgtttcatatattaaataatagtggaagttttcaatttaattagtttatttatttatttatttatttttgagccggtgtttccctctttttgccaaggctggggtgcaatggcacatggttgcagctcactgcaatctccacctcccaggttcaaaggattcttctgcctcatcctcccaagtagctgggattacaggcgtgtgccactatgccaggctaatttttgtattattagtagagacaaggtttcaccatgttggtgaggctgctctcaaaatcccgacttcaggtgatccacccgcctcagcctcctaaagtgttgggattacaggcatgagccactgcgcctggccaattgtatttttatgttagaaatatatatgggagttacaatactttgtttccaatgttccgctggaaaccactggttgaaaggataggtcccagtgtcagctgcccagttggcagttttggatagaatataagttctatgaaggcatggatgaagtatccttcatggtaatgatggtaatgttagtatagtcacttgtttaatgttgtataactttttaactcttccaacttcaatttcatctatatctttcatagcagtccagtaaagtagtatcaattatagatatcattcctactttcagataaagtaactgaggctcactagttttgacttgctcaaggttacgtaaatgataagtgacagactggatttaaagggcggagtccactttactaaactgcctctgtcttctagccaagtttgttatgtaaagtaagtattcagacattggctaagtatattattaatcaagaaaacagtagaacaggtttaaggaatttttttttccctctcctcagtgtcaaaaagcagtcaagtaaaagatccaagataaataacttcagttcccaaaaataacttcaattccaaaatttccctatgactaggtatatctaattggatagctgataaaatgagtgggaaattgaagaagggatattttgagaatgtgtggcaacttaatggtaatattgaagaagcaaatggatagttattgaatcataatagttttttaaacttaaatactagggcttgatcttcatattttaggaaattatctatttgttgcagtagaaattagcataaatgaatggaaacttaaattatctcatctgtgcaaggcagtcttcagagactgatgtttatataagtgaaaactcagaaaaattttttggctgcatttcaagctggatagcggggtcaaaacttcaacttcttaattggtgatacaacgtcagaaatcacaaaagaagtatttcacaggaaaaaatgacataccccgaaaacattcaaatcaagaaaatcacaggggtacagtggatggtcccccttaaggtactgcgtacttggcttccccgctggtaaatgcctctcttttactaagttgttgtcgtgcagagtggcattgcagctctgtacttttacagaataatttcaggttctaaaattgatacattatttcagattgtaagaatagtataaaataaaattttaaaagggaaaataattccatcaatttaatggaatgtgtagggtttaagttataacaacaaaaacaaagttgtagttttttaggattactcatataaatagtgtgtctattaagaattactggctttatgaatattaaataagaaggctggccgtggtggatcatgcctgtaatcccagcactttgggaggccgaggcagacggatcacctgaggtcaggagttcaagaccagcctggccaacatggcgaaaccctgtctctactaaaaatacaaaaattagccgggcgtggtgacgcatgcctgtaatcccagctactcaggcggctgaggcaggagaattgcttgaacccggaagacggaggttgcagtgagctgagatcgcgccactgcactccagcctgggtgacagaacaagactccatcttgaaaaaaaaaaaaaattaagacaaccacagatataaggatttgcaattagaaagcttgaagggaaatttttggaacttctaggtcaacctaaaattacaaatagggaagcagctttggagaggaacatttgcacttctgaagtaatactgtgatttggactgtcagacattgtgatatattggcatcaccacacctctgttaattataaacttacctattctcagtgccttgttaactgttgaaataggacttgacatttgttgttcttcctcttctgttattcatttattcactcatttagtagttaattacttcctagtgccagatagttttctaggtactgaataaacaaaaatcctattgtcatagttatgtttttgtggaaagaacaacctgatagactatcgtgaaaaataaatgagttagtatacataaaacacagcccatgagatatagtctgtaattatcatccctgcttcatttatttatttatttatttatttatttagagaatggatctgattctgtcatccaggccggagttcagtggctggatcattgctcactgtaacctcaaaacacctggcctcaagtgattcccccaacctcggcgttccaaagtgctgggattaaaggcatgagccactgtacctggccattgctcctgttttaaagatgaggaaactgaaagtacagagaggaacgtgacttgctcaggatcacacagccaatcagtggcagagcagtctaggcagtctaggcctgaaggcattattctttctttctgttctgcgtcaaaaaccctaggcaggcatggtaaaaagactgaaagagccaaggcaacataggtacctgaagaatgggagaacacctatgaggactgctagaaattttaggcagccctttaaaggccttgggcaacaatttgaacgtgactcatgagtcagttaattctctgcacctttttttttttagagaatacaatggataaagcaatgacctttgtaacatgtaaacctgtatttgaatcctttcctctccatttaattttgcagagtcaccttttcttcattagaaagaaattttatcccaaagagattatcgtgaggctcaaataatataggtggaagccctttgggtttaaaaaaaagccttttctgtcatttctgggtatctcccgtcagtgattttagtaattgtttacctctctggctcttcgtgagaagacaaattgtaggaagaagtggaggatggcattgggtaggatgcttagttctagttccaccacttccttaggtcttttttttgtcccccaagactatatcatttctgtgttctcttgaacctgtaagatttatgagtaatctgtacaatatttataaagtatgaaatctctgccattgtggcacaaaagtagccatagacaatgtataaatgaatgggcatgctgttctccagtaaaactatatttatagaaataggcagtcttctccaattttagtttgctcacccctttcctatagaactcaggtttatcatatacaatgttacacattattcctttgaataaattgtttacctaatactttttaaatttgggcattttctaggacattctattgtttttatttttaacttgtgttatactgcagtgaatgtcttcctgtgtgtagcattttgtttgtgtatgtgtgtcaatatctataaagtagctcttaagaactctggaaacattgtcagactgcttcctcaaacagcagaggtgggagggagcatcggcctaaccctacctggcctgccttaccagcatgcaaccaaggagaagagaataggatcaagagccagtgccagagagaagtacataatacaactttatggagtttaggttgcatcctataaagttaccatgttacactgtttcgatctaccaaagtagaagttttacatagtttagtatgaagttaattttattaaccttttcacacaacacaccctctcatattgctgcccaacaatgtcctgggtctttgtttccatggtcatcatattgagtagggttttagcagggacttgagtagttgggaactgaactcatgctagtgaagccattcttcactagaagcagacatatgggatccagaatatcatgaacaaccagctgggtacagtggctcacacctgtaatcccagcactttgggaggctgaaggaagcagatcacctcaggtcaggagtttgagaccagcctggccaacatggtgaaaccctatctctactaaaaatacaaaaattagccaggcctggtagcacatgcctgtagtcgcagctacttgggaggctgaggcaggagaatcgcttgaacctgggaggcggaggttgcagtgagccgacatctcgccagtgtactccagcctgggcaacagagtgagactctgtctgaaaaaaagagaatatcatgaatatcaccaaagataaaagcaagatgcggatatgagtagcccagagtaacttttcctgtgctatataacacagtgagtggtgattcccacaattcaagtccagtttttctggattctaaagccatacatttttaactctccccctaaatatgatttgaattcagagagtcagatgcaataaggtaattttaactttaagtgtagtttagcccacacatttctctaaactgggggttggcaaactacaaacctctttttgtaagtaaagttttattggaacacagcctagctcattcatttatgtattccctttgcaccttttaggttgagtagttgtgactgaggtcttccagccttcaagcctaaaatatttactatctagtccttcaaaaagaagtttgccaacctctgcaaacaagtgaaataatgtgtattagagtagagcaggagtccacaaactacaacctctggagccaaaaccaccctactgtctgtttttgtaaacagaaattttatagaaacatagttgacccctgtgccaatttgtttgagtcttgcttttgatggcttttgtgctacaagggcagagttgaacagttgcaagagaactaagtggcctgcaaagcctagtggtctttgctgtctggccattataggaagtgtttaccaaaccctgcatttgatcatggaatcccagaatgtttatacctttgaggatttttttttctactttccatattttacaggcaacagaactaaagcctcgtaaaatcttgcccaaggttctacaaatagtcttttctattaaattaagtcagagcctgaaattgtctgtgcccaagtctctcctcagaaatttagcacagcattttccctttctgtctcccacatgctacacagtcatcctggatcatgtgccccgcctccatgaggagatgttctaacatgagggtgactaggctctggagccagagcatcttagttcaaatcctggatctgttaaaaataatagttatttttcagttctaacactgaaataagacaaaaggccatattactgaaataaagtgtaaagaatatatttaatactcaggttactttagccccctcatgatcagaatatgctaataaattgagagattgacagaaaaaaaggattctgtttcactgtggctcacacctgtaatcccatcactttgggaggccgaggtgggtggatcacttgtctggagttcaagaccagcctggccaacatggcaaaaccccgtctctactaaacaatacaaaaattagccaggcgtggtggtaagcacctttaatcccagctactcgggaggttgaggcaagagaatcgcttgaacctgggaggtgcaagttgcagtgagccaagatcacaccactgcactccagcctgggcaacacagcaagactccatccctggaaaaaaaaagttcatcatttgttcttgtagtttcctagtgtggcccttgtctcagtggaaaattgtagtgtgatagactgaggagaattctgtttctgccacttcgcctgttgccttggtaggagctccttatctctgagctgagctccttttgtccttggtaaaatgtggttattatcatctgcatcctcatagtcttcttgtaaggactgtgaagtcacttttgaaaaatgccttgaatatgccagatggtctgttttctttcttttttgttttgttttgttttgttttcccttggccttcattcctggaagtgttttgttatatacattttgtttggtggccaacagtgctaaccacagaaaagtttgtatgtcttctttttctagaataattcttacagtgtaacctctcagggtgaagtttttgttttgaaaggggcacatttactgtgaatgagagccatggaaatggacctgaaatttgaagacagattttacttggttttcttttctcttatttgtttgcagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtgagttgctacaaatgagacatacgtttagttttgttttatagtatatatgaatatgtgtgtacatttttggaattttagtttgattatacaaaatatctttggcttagaaatattaggcatgctatgtaaaaccttactggaaaaataaattgaccaacattattgagagtattttttcaaagtgttccaaaagtaatggaccaatgattactttaaatgaaatcatgtaatggaccacagaattgcaaattactaataaagaaaagccattttgcttattgccatgtaataacatgttgcatgatacaagtagatacgtatgtttatgctgcaacaagtataggtgatactaattgggcaacttttaaacaagaccataaataactgaaatcaaagttcttagtatttatgcagcctgttggtttgcgagggctgccataacaaagtaccacagactgggtggcttaaggaaggttgttttttcacagttttggaggctagaagtccaagattgaggtgttgtcaggtttggtttcttccaaggccacactccttggcttgcagatgtctgcttgcttactgggctcctaaacagtcttttctgattgtcctaatgtcctcttcttataagggcatcagtcatattggattggggcccacccatatgacctaattttaccttaatgacctctttaaagctctgtctccaaatacagtcatatggctgtgatacagggggttagaatttcaacgtatgaattttgagggggacacaattcagactataaactgcagttaatgtttactgttaaattaaatctataactgactaaaccacacaaacaggagatttcaaattagactttattagttttggaaggaagagatgaaatgttgttactttttctgttttatgtagttgtaaaagccactaaaaatgtacatgtacaaatcatcccaagccaggcaacattagtaatgaatgactgcagcacagaggtaagagagatgatttaaaggaggatgaattgtctgcaaaggtgctgggcaagatctagactaattcatccccttcattttaagtttaggttttaaatagctttgtttggcttgatcctagagctacacatttacttttaacttgtttactttgtaccctatcatttaggatatgctatgtactattgtactctatttgatatttcaaacattctctcatttagtgaagaagctcccaaccggagtgctcagaacctacattgcctcacctgtgaagtgagcatgtgggactgaattgcctttgaggtctctttcagctcttaatgatctgttatcccatagtaagatacattatttttaatctcgttggatcttaaacaccaaaaataatagtatttaagacgtaggatgctatcttgtcattattttaatgcacatgtcaacacacgaggttttgctagatgttatgataaagcaagcgaaacagcaggctactgctcctcaaatatctacagtcaatgaaatattgactggcgttgtgggaaaatatctcaaaagtattttatttacaatttaaaatatattcttttgcctaaagaaacaatgaaacaactataacttgtttttgttattgtgttagtgtagtcatacatatgatacagttttataatctgcttgataagggtacgtctctgggtttttcacactttgcaacaagtgggaaagaacttcgacaaaaacattaaaacattatcaacctggttgcacgtttttctgattattttcagtgctcttaggtttttagaccatatcaaaattctctctctacacacatgatttataagggaaagaaaagtttgcagtatgcctaaaatgttcctcaggttaattatatcttgttttgcatagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcacttggggatcttgtttaaaaaaaaaaaaaaaaaggagattctgattcaggtgatctgggctgagtacttacagtatgcatttctaataaacttctgggtgttgctactgatattggttcaagaactaaattctgagtaacaagtataaaccgaatgtccataaagtataatttcttttagtatcatatggttataatgcttgcattttgtatatatgttgcatacaggttttgcttttctcttttttcttattaaaaaggttataaaggtacactgtagaaactgtagggagtaggggaaagcttggcatctcatgccaccattcagaggtaaccatgtttggcattttaaaaatgcatttatagtgtgtgtgtgtgtgtgtgtgtgtgtgtgtgtgtgcgcgcatacatatatatgtatgtattatacatatacgttaatatacatataatatacatatattactgtgcaaaagttgataaattgattatgattatgtataaactttgatatcttctcatatttaatataatatagttgtgagcactcttccatatcattaaataactttctagacattttaaatgaatatatagaaaatgaaacatcattaatcagtcccttatcttagaatatttatttcggttatttacaatctattagtagtttaaaagtacttcatggaaaatccttatacatgcatcttagttaacttgaacttttatttttagagaagacatgccaggctgttctaggctattgatacatattgccaattaccttcctgaaagattgtaccactttccacttaggcacagagtgtgaatgcctgttttaattactctatttacatcagtaaagactatatctgaaattatctcatttttggggacaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggtaatcaagcacacattttatcattaataaaaatatgaatgctgaataccatcctccctcctaagcagtcctaccagtgttgctcgccattttattggtcatcccagttgtaactttttatgtgatctgttaacgatctttatctcctattgatacatattctgtcactctccaagtcctatttatgagtttttctttcacatgtctgttgtttccattgccccctttccattttctacactctggcatgcagctttgtcctgtttcccccatgctatggattagcctcctgccggtaaccacctgaggggttcttcctgcctgctgcataaagaaaaaccatggcaatatagtagagaaagagcttaagagacactaggctggccatgccacgtgggggatggagttcatattcaaattatcttgtccaaagctcataggtaggggtttttcaaaggcagcttgggggaaggggtgggggtggccaggtaacagatgcttgctgctgattggttggggtgggtgaaatcacagggagttgaagctgtcctcctgtgggctgaattgcttctaggtggggccataggagtggggttgctgggtccaggtagaaccacgggtgtcagacatgcaaaaataaaataaaataaaataagataaggtaagataaaataaaataaaataaaataataaataaaataaatataaaatttccctgaaaagatatttcaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttagctctctttcactctcatagttttctcactggtataatttttgcaaaggcggtttcatgcctgccatctctttcgtcgctacctctcccagttcccattcttagctgttttatgaaatgcttctagtttcatcctcttataccaagttctgggagactgatttgagtaataataaaactccagtttcccatacagccggctctgcgtgaattaaactcattttctattgcaatttccctgtcttgataatcagttctgtgtaggccgtgaggaaggagaacccgttgggtgattacgagactgtgttactgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaatttgccacctaaaaaaaaatctcaaaatcctctctatgctttgatgtccagcaaaaaaaaaaaaaaaaaaaaaaaagttatcagtatagctctattactctcaaccagaggtggcatttttcatctttacccataagccccatggtatatttcttagtttgggaaattatatcataatactttgaatctgtctagtcagaaatttagataatttaaaaaaaaattatttttctgaaagtatagctggatctagcttaggatctacatctatctaatatagttccttaacatttgttaaatggccacggataagtcctgtaatgccatactttgctttaggatcatgtgactaaggggtaaggaattggaaagcaatggggagctagcagaatttgaaaaattatataggtaggttatttttccttaatacattgaaatagcctcaaattctcagagaatacaatgtttaatcctctaatatctgtagagttcatggctcaaatttgtattatttgaataaactactaatagattaataattactcaactaaaacactttgaaatgtgagagttcccttatctccctcgcaggcatatgacagaggtgtggcttctcacacctttggttgcccttgccctaccacccaaacccctagggggagcatgcagaggggcaggtgcagaggccatggggggtgcttttgggctctggccccacagcagtgtctaggagtggatgttggagactcctgaagcccaagtgggcatgtgttacagtgtgctctttcagcttagccgtctgcagatggcttgtgttaatcaggtcattagaccccatgccttattgcaagggcaggggtccaatgtgacagcctaagttcttgctcagtgtaccagaagaattggatcacacgtgggctggaaggatgagcacaaggttttattgagtggtggaggtggctctccgcgagacgactctcagccagagaaggaggatggaggggaaaggtgttcttcccctggagtccacttgttcctgttctcctctgggttcaaatacctcttccctccttttctgctgtgctgtcccaccactctccacagctctgtgccgctctgttcctctgctcctctggatgttcagctccttgtatctgtgcctgctaagattttgggtttatatgggggaaggatggggggcatggcgggccaaaaggcaccttttttggtgtgaaaacagaaatgcctgtcttctcttagggccttaggtcttcaggcttgagggtggggcctttgctgagggaccaccctcttctacccagtatttccctgtctcctgtccatatcaacattactaactttttcatctgcagactaataatgctaaggtgtggcatttttcaactgtgagactatgtgaaggtttttcctgtccaactgatggcatcctcccataattctacccctttcttaaaagaatcttttgcagtatttctccaagtttattctagagaatttcttgtctgtgaaatgctctagttaatcaaaattggaaaacggagcatatcatatccccttctcaaattcaccaaagtgaagtcctaatgtgtcttaatgtatctgcatgagacaggaagctgagatctattcaacaacaaaaatccaaacaagcatcaagaggaggagtgttagcacttgagcctagggagactgtggctcctgcctgaaagatgggagcctcagtcacagctgctttaccaagtgtcatatgctatgtttctgaggactcctgctaaagctcccttctccctccagccaaccacttttgttttagacaagggctgggtttatgaaggactgttttcatgactaaagctttatagaaggtttaagataaggagatggaattgagtgaagtaggaaatatgaaagcagatattataatctggcttcctgatttttcactagcatttttgtttataaattagttctgttctaagaatccaatgacgtaatagaaactctcaaagattcttaacttgagatatagggagtctttgaaactgctgaaattacagacagcatttattgtttatgagcatttctgaatctagagctttcactagatttgtaaagaatgtgggccaaaagattaagagccaatcctgtatcttgtactcaaaatgtttgtaattctcacctttttatcccccagactcctcttgctctctcttcattttcacagtgttactggaaaggggtcctgatccagaccccaagagagggctcttggatcttgtgcaagaaagaatttagggcgagtcctcaatgcaaagtgaaagcaagtttattaagaaagtaaaggaataaaagaatggctactccatagacagagcagccctgagggcagctggttgtccatttttatggttatttcttgattgtatgctaaacaagggatggattattcatgcctcccctttttagaccatagagggtaacttcctgacattgtcatggcattcttttttttttttgacagagtctcactgtgttgtccaggctggagtgcggtaaagcaatcttggctcactgcaacctctgcctcctgggtttaaatgattctcctgcctcagcctcccaagtagctgggattacaggcatgacccaccatgcccagccaatttttgtatttttagttgaaacagggttttgccatgttggccaggctggtcttgaactcctgacttcaggtgatctgcctaccttggcctcccaaagtgctgcaattacagatgtgagccaccaaacctggcctgtcatggcattcttaaactgtcatggtgctggtgggagtgtagcagtgaggaagaccagaggtcactctcatcgccatcttggttttggtgggttttagctggcttctttactgcagcctgtctgttctatcagcaaggtctttatgacctgaatcttgtgctgacctcctatctcattctatgacttagaatgccttaactgtctgggaatgcagcccagtaggtctcagcctcatcttacccagctcctattcaagatggagttgctctgggtcaaacacctttgacaacatcattaagcctcagttctcacactgtttttgttttgtttgtgtgtgcaatgatgggcaaatctctgccttataggatggtagaaaaaaggaacttaatattgtaatgactgttttgtgccagataattgctttaaactgtatcagcatcttatttagtcctgttaatgatatgaatgttatcttcataacagctgccattttattaaggacttatcagagaaaaacactgttctaagcacttgttacccattattacattgaattttcataacaaccctttgaggtaagcatgattatacccactttaatagaagtgaactgtagttttgtaatgttaggttccttgccaaatgttacacagatagtaagtgataaaatcatatgccctgaaattacattatgctgccaaacttaaatttcttttttatcctttatattagtatattcttaggtttaaacaagacaactagttaacacatactagattttgtccacagttcctggctcataactcccatagcccttgtcactatcttttaacgttggggcacattaggcctcagaagtaggcctcagaaaacagagtctctctctctctctctctctgatcttcttccgccctcctctcacctgcccagggcagcactctaatcttctcctgcctttctgatcttgggtcataagaccttcatttccaaagatgtcctgtgtcataccctaaaggaaggaacactgaacagagagaggctcagaagaatctggacaggccttgctgtgtttacatcattccctttatgtccagtcacatctctacatggttgtcagttgtgcctatttgatgaagtccccatataaggctcacaaggacagggtgcagagagcttccagatagctgaacaagtggaagttcctggagggtggcgtgttcagggagggcatggaagctgtgtgccccttcccccataccttgccctactcatttcttcatctgtttcatttgtagtatcttttataataaaccactaaacattagttagtatttctctgagttctgtgagtcactctagcaaattaattgaacccaaggagggtgtcataggatccccacattatagctggttggccagaagcacaggtaaacaacctagggctttcaattggcatgagaagtagggggcagttttgtgggacggagccctcagcctgtgagatctgatgccatctctaagtacacagtgtcaaaactggattggaggacacccagctagtattcactgtgaaattggttgcttgcttgatttgtggggaaaaacccacatgcatttgatcacagaagtcttttgtgttgacagttgatagtgttcagtgagagaattaaaaaaaaattgagtttcttcttcaacatactctctcaatgtgaaaccacagaaactatttccattcaaagatggaaatggtttgtttgcatcttagtttttatttatacatcttagaagaaatgtccaagctttgttttttctctcaccctatatataaaattacctatgaggcacagatttttatgatccttgattatatagactttgtccaaattgtgtgttttatagcattactgtaacttgttatagtaatctttgtgtatattatgtctcttaacattgtcttccatattgttaatgaccatctcatatttatctctgtatcatgtatatcttcaaccaatgtgactggcttaggagaaaaaattagtgaacaattaactagtgtttgtgtaatctatacaattgtcaaggttacaattgctatttttgaagaaatcgttgttgtttttctctttgtttcatctcagttccattttgtcatgtattcttttttttttttttttttttttttttgaggcggagtcttgctctgtcacccgggctggagtgcagtggtgcaatctcggctcactgcaagctccacctcctgggttcatgccattctcctgcctcagcctcccgagtagctgggactacaggcacccgccaccacgcccagctaatttttttttgtatttttagtagggacggggtttcactgtgttagccaggatggtctcaatctcctgacctcgtgatccgcccgcctcggcctcccaatgctgggattacaggcgtgagccaccgcgcctggccccttgtcatgtattcttaacctgtgttatatctaagagaagctgtgagagacgggaccatttgtggataggtgcagagggcatgaagtagcccagaaagaatctttgccattgactaaattttagcctagtaaaaaacatctggtaaccactgaaaaactagaacagtgtgatatgacaatgcccagttgaataagaaattcaaatagtttatagtaacaaaaaataatttttaccacattgtgactagtgccctaaaaacaaatttgaaggagcagagagagagaggaagtgagttttcgctgggggctggtgagtggaggctactttatgagcagttttgaaaattacaagttagggaaaaactcttaggggagttttaagtggtgagcaacaggcacttgaggttacaggagcagcagcataaagatatagaacagagaggccatttggcagtcttggggaaactccaagaagtcgaatgtgtctaaagctgtggttctctctctgtgtgtgtgtgtgtgtgtgtgtgtgcgcgcgtgtgtttgtgtgtgtgtgcatgtgtatgtatgtgtgaaatcgctaatacagagaagctgttagaacaattttctcacttcccaaaaatgtccgttcattcatgggcctaggcaactctcctttgtgtgtcttacagcccaacactgtcatataaggtgtggttctataatgaaacagttttatctgttgtttacggagctagtcagcctgtgttatgcttgttactggttgagggtgtccaggttcttggcttcttgaacaaagaattggacaaaactcacaaatgaggcaaggaaagaatgaagcaacaaaagcggagatttattgaaaatgaaagcacactccacaggatgggagtgggcctaagtaaatgattcaaggccctggttacagaattttctggggtttcaataccgtctagaggtttcccattggttacctggtgtatgccttatgtaaatgaagagggtggagttaagttacaaagtcatttactcagtataggccttgtgttaatggagagggtgttactcctgggggttgtggcccatgtaaacggagaggatgaagtgaagtgacaaagcccttcgcattcctgccattgctgaagtgtttccactttatttagttctaggaagtcagtgtgaattggccttatgttccctgcctccagaacctgttctcctgcctcacatagacccttttttccctttgccaacttcacttcttttacagccacctcactaccaatgtgtctgtctcctaagtcaaacatcagtgattcctctgttttctctaaacccttcttatgtcttctacttctcatctctttcttggtcaaaaatctttcaaaaatgagtaagaatgcagctattcaggcaaactaaaaataacatcacagtgatatacaaaaccagtgtcatttcacaaaggaaaattatcaatactagatcctgaaaaagaaacagcgaatgaaagccatttacacaactccattgtgtaattgacacattgaatcactcataaaacaggtgctctgggtctgaatctagatcctagctagtctggtagctgaaatcatagaattatagtagagtttaggaaatcatcctcaaaggaaagattatatgttgatatcaaatgtatatttcctttctaggcccaaacctgcaccactgactgctgaaatacagcaaaagattttgcatttgccaacatcttgggactggagaaatgttcatggtatcaattttgtcagtcctgttcgaaaccaaggtaaaaaaataagcctaagttttttgttaatttgtttggaactatttattgaacagttgctctgtgtgatggatttcggggatacctagatggaatgggcatgatcccctttttacagaaatagaaaataggtggcctatgaattattctttccttttatatccatgacaaactttagtaaaaaattttcttttctactgagcttagcatttattcagtactcttctcaatatattttccaggtagctagtgacaatcagagtgatatgtaagacaaactcatttgtcctcctagtaggaaagattctagtagaagcaaagaattgtgtaccattctgcaagtggtttgttggaatctttctttgatacctgttcctgtattcccccacccccattaatttagtcattaattactacatgaacccgtaaaataaatccttaaattattttcctggtagattttttgagctgtgtaaggacctttcaattcactttacattagaatacgatatgtgatggtaagtattaacccagcttcctgagtgatggcgtgagggcggaacccaggttcatgaaaagtattcctattattgaattttaccagttattttcagaagtttgatacaatgtgagttgatttcataacatgtcctctaactgcacttgatagcaaattatcttgttatcctgagttgtagccaacaatgacttggagaatctatgcaatactcagttttattacttctaagctcattttgaagataatactacccatggctgatttgttactataaaataggtttagtatttgctgtctggaaacattctgattagtgtctcctgggaggattataaatttatagtacccaaagataaactgttgtttccctttcctaaacttttagtgataatcagtctctgccgtgtctcattttcatcacttgccctccaagctcccatctcactgaattcttgcagtgttctgaatgttgagagccccaagtgggtcttataacagccagtcagcaacatttctgtttttcatctgacaccaagggtctcgtctctttgcttttctaccagttattctgggctcttcagctctaaagaaagtataggtcctgaaatctttccctaccttctcaatttcctggggagggcttctttggaaagtgggattggaaataagataaatttgaagataattgagaaatgaatggaaagtgaaattgaagggtccatgttaagagattgcaagttatgctatcaccaaatagattttttgtgcctgagaggattaattcatagtgcatattatgtgttgactttatcattgaggtcctggcacatgatagcattggcatgatataatttgagctactgatactatagtgttgcttctggtgttgttaccagaacatctaaaatatattaggatttttttaatggcagaggaaatgaagactaatatgacatagtccttgtcctagtgatttacagtttagcaagacatacaagcaaaacattaaagtaaagcatgataactactttaataaagcattttttaaattcattggtaacataagagaaggtagaagagtttagcaaacccttcccaaaagaaatgattgacaagttatatgagataataattcagggaaaggaaattcgactttctaaagccaaattatttgacattggttttcatatagcttggtaaaagctgttattttctcccatgttctttattctttgactgttataagtatgatttgtacagagaaatggcaatttcaaaacagagggctttgatggattaattgctttgaattgatccctcatctacagtatcttgtcaggtacttgagaaaataatgtacttaaagtttcctcttttgactttcttttggtattctatactgtaagttggggaaaaaagtattttctcttcctgctaattgggctacttgaaaattcccaccaactttgccaataccagtgttctgtataacccagaattcagaattagctgcaattaagggaattcacagcttttctgtagtcagagagcaaattgaaattaaagaaaaaagaaatagtgggaggacaaatgaggttttacctttacacttgaaaacagatttaagaacaagccttatacctagatttattaatactttgaggtatgagagggaagagaagcttagaaatacggcagaatgggctttctttgttcttctcccagctatgctgtttttatttattattgtatttttaagagagaagggaagtgtctctcctgggtcacattaattaggaaatacagagtgttttcataatgcgtaaagtctagtccatttaagtcttgtttcaaaatgctatttatattatttgagcaggaaggcagagaccttaaactgctccacccaattcattttacacaaaagattaaaaagaaaaaaacagtgtcaaaaggtcaagtgcccagtgttgcacaactaatgataggcaaaacaagagaggaggggaaaaaaaagaatcctgactcccgactcctagttcagtgtgttcttcactgttagaaggtgctgctgaacatagttataccatatgaagatcacactatctatttgagattgtagaaatttgattactgcagagctctggctgggctagattcacttcttattctttattgcattgcagtattcttaagagataaatggctcttttagaatcagattggccttggctgttgaaatgaggcattaattaccttggtagctgacacattcttacaggtcaggggcttgatgaagtttatcttcttcccttgttcctgtgattgctctgtaaatagaacacattcagagcccttgaatgcacttgcagcctgtgcctcccacagtgatcgatggtcagataatgggagtttaatgaccagtactgagagagattatttccatggctgctatgggccaagaaagctgggtggtcagaaagggaccttttccagactctcctgggttgtgttatttctttgacattggtttcctttcatgaggcgccaaggtgtatttgtaagttgtccagtgttgcacagctaatgaggggcaaaacaagaaaggaggaaaaaaaaagtatcctcactcctagttcagtgtgttcttcactgttggaaggtactgctgaacacagttatatgttcagtgtacaatgtacaatgttctttgacattccgtcatttgaaggatgggtcctatggatagtatcatctgcatggttttgaaaacaaaagatataagctaattttgccctgtctagtgactacgagacagggagagaaaatctgaatatttgttaaagtagacacagacccataaattgaaaaggacactaatcctgccttaggagacagtaaggcacttgtccctgctatctattagctgtgtgtccttggacagctcattgcttctttctgagccaccgttacacgttatctatcaagtgagcaggttgtacactagatgaattcacaggtccttcttccaagtgcttttctaatcttcataatttagataatctctcagtagcaaaacagtgtacaatatggtcaatctgagatttttagggggagaattttagggaacatcagaaatggcagtagttaaaaggaaataggactcacaggctgacttctctctataacttcacatggtagaagggatgagagttctctctggagccttttgtattaggtcactaatcccaaaggccccacctcctaagaccatcacttttgggattggggttttaacatgattttagagggacataaaccttcatctcattgcattagagatatttgaaagctcagctcacgtgtattcctccacagctcacatgtattcctccatcacccaacctgatggctttgaacgttgtagacataaatcctttcatcattatcaagaatattgccaaaagcttctcagaaattatgaggggtttttttagtttctaaaatattctcaaagaaagtcccatgtactaatgtttgccttttgatgaaaaaggatgaaatcttaatgattgccttaataagctcaacaatgcttgttagttgagtcttcttattgtgctgattcttataaacaacaacattcagtataaacattaatgtatgtgattcactaaggtttttgcatgattctctgtgaggcttcagatgtctcttggattatgtgtctttttttcatcgccagcatcctgtggcagctgctactcatttgcttctatgggtatgctagaagcgagaatccgtatactaaccaacaattctcagaccccaatcctaagccctcaggaggttgtgtcttgtagccagtatgctcaaggtaagtgttgcatttcagacaccatttatgagctatttacctgtgtgcagctggctgttgttggcaaaggcaaaaggatgatgcagtagagagagcgcagtgtctatagtcagaaaatctgagtgcaagtctggccctatcacttattaatggatgattgctcatggaatttactgtaccatccagcaaaatgtcaatagttactatatattgagtgagctctgcttgttacatatattgcctaacaatgctcaaaactctgagaagtagtaagtataatccctatttatgggcggggaacaggaactaagaaatttttctaataatttgaaggtctcacagcttttagcattggagtttcacttctaatcatcgtctccaaaacccaacttttattaaaactatactaacactggtttctctctgggagaattttaaaattctgtacttagggctgggcacagtggcttatgcctataaccctatcactttgggaggctgagatgggtgaatctcttgagtcctagagtttgagaccagcctgggcaacacggcgaaaccccttctctattaaaaatacaaaaaattagctgggcgtggtggtgtgtgcttgtagtcccagctattcaggaggcggaggtgtaagaatcacctgagcccaggaggtcaaggctgcagtgagccgatatcatgccactgcactccagcctgggcaaacggagtgaggccctgttatgaaaaaaaaaaaatctgtacttaggctttcagatcaggctgtatgtgatgtatgtcgaaaacacagctataattgattgagggagaaacgttaccattttaaagtttatgctttcaagcccagatttggccactaggaatttcccagctcactagtgaaactgctgatgagtgattatttgccagtgagcctttcattctttctaaaatatgtactactagttgtgacttgtaggctataggggctataatatatcaagacaatctttatcctcatgaagcttacagttaagtaagagatagagattaaataattataacaacagagtgaagaacagtgaagaaaaagtacagagttataatatatataatagggccaggactgcatgaggaaggtaggaaagacatttcggcaagaggttgtcagggaaaagacttgcttgagaaagagccaagttgtggggtctggctgcttagcaatgaccataatacctaacttttgctatttttacatgaagtaactaatttaaccctatgaggaaagtactactaccatctagattttacaggtaagtaagcagagatacagagaagttaaactcttcacacggctttggctttaaacctatataggcttcagagcctccccacttaaccactttgccatagctacatccatattaggtgctaagtagatatctgttaagtagaaggaggatgaaaggatagttagctagttggaaaatggatggatgaatgaagtgatgcttaagctaagaacaactttcaggggtaacatgcaaagaataatggagcaaagaagaaaaaatagaaaatgggataatcctttttctactaaggggtaaccatgtgtgttattcatcttcaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcat

SEQ ID NO: 9366 - DNA, 1115 bp, Homo sapiens
gtaacagatgcttgctgctgattggttggggtgggtgaaatcacagggagttgaagctgtcctcctgtgggctgaattgcttctaggtggggccataggagtggggttgctgggtccaggtagaaccacgggtgtcagacatgcaaaaataaaataaaataaaataagataaggtaagataaaataaaataaaataaaataataaataaaataaatataaaatttccctgaaaagatatttcaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttagctctctttcactctcatagttttctcactggtataatttttgcaaaggcggtttcatgcctgccatctctttcgtcgctacctctcccagttcccattcttagctgttttatgaaatgcttctagtttcatcctcttataccaagttctgggagactgatttgagtactaataaaactccagtttcccatacagccggctctgcgtgaattaaactcattttctattgcaatttccctgtcttgataatcagttctgtgtaggccgtgaggaaggagaacccgttgggtgattacgagactgtgttactgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaatttgccacctaaaaaaaaatctcaaaatcctctctatgctttgatgtccagcaaaaaaaaaaaaaaaaaaaaa

SEQ ID NO: 9367 - DNA, 1109 bp, Homo sapiens
gtaacagatgcttgctgctgattggttggggtgggtgaaatcacagggagttgaagctgtcctcctgtgggctgaattgcttctaggtggggccataggagtggggttgctgggtccaggtagaaccacgggtgtcagacatgcaaaaataaaataaaataaaataagataaggtaagataaaataaaataaaataaaataataaataaaataaatataaaatttccctgaaaagatatttcaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttagctctctttcactctcatagttttctcactggtataatttttgcaaaggcggtttcatgcctgccatctctttcgtcgctacctctcccagttcccattcttagctgttttatgaaatgcttctagtttcatcctcttataccaagttctgggagactgatttgagtaataataaaactccagtttcccatacagccggctctgcgtgaattaaactcattttctattgcaatttccctgtcttgataatcagttctgtgtaggccgtgaggaaggagaacccgttgggtgattacgagactgtgttactgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaattttgccacctaaaaaaaaatctcaaaatcctctctatgctttgatgtccagcaaaaaaaaaaaaaa

SEQ ID NO: 9368 - DNA, 379 bp, Homo sapiens
atactagctgcatgcttggaaatttcaccttaacattctgagtttcagagttttgtgcaaaacccacgtattttctgcattaaaattcactataatgatgtttttaccctccttgaactgcagtagggctccaggagtatgcaccatttaaagtttggcttcctggacctcctggcatgctgccacatacctttgatcttttcaccacatggtggcacagaaacagcactggaaggcatagccagggtcggaatcattggaaggcctccaaggagatgagatacattttctttttattgttactgattgaatgtaatttccatcctattttgtgcccagcctcactgctatgtgaacatataaacagacctttgaaatc

SEQ ID NO: 9369 - DNA, 3582 bp, Homo sapiens
agtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtgagttgctacaaatgagacatacgtttagttttgttttatagtatatatgaatatgtgtgtacatttttggaattttagtttgattatacaaaatatctttggcttagaaatattaggcatgctatgtaaaaccttactggaaaaataaattgaccaacattattgagagtattttttcaaagtgttccaaaagtaatggaccaatgattactttaaatgaaatcatgtaatggaccacagaattgcaaattactaataaagaaaagccattttgctgattgccatgtactaacatgttgcatgatacaagtagatacgtatgtttatgctgcaacaagtataggtgatactaattgggcaacttttaaacaagaccataaataactgaaatcaaagttcttagtatttatgcagcctgttggtttgcgagggctgccataacaaagtaccacagactgggtggcttaaggaaggttgttttttcacagttttggaggctagaagtccaagattgaggtgttgtcaggtttggtttcttccaaggccacactccttggcttgcagatgtctgcttgcttactgggctcctaaacagtcttttctgattgtcctaatgtcctcttcttataagggcatcagtcatattggattggggcccacccatatgacctaattttaccttaatgacctctttaaagctctgtctccaaatacagtcatatggctgtgatacagggggttagaatttcaacgtatgaattttgagggggacacaattcagactataaactgcagttaatgtttactgttaaattaaatctataactgactaaaccacacaaacaggagatttcaaattagactttattagttttggaaggaagagatgaaatgttgttactttttctgttttatgtagttgtaaaagccactaaaaatgtacatgtacaaatcatcccaagccaggcaacattagtaatgaatgactgcagcacagaggtaagagagatgatttaaaggaggatgaattgtctgcaaaggtgctgggcaagatctagactaattcatccccttcattttaagtttaggttttaaatagctttgtttgtcttgatcctagagctacacatttacttttaacttgtttactttgtaccctatcatttaggatatgctatgtactattgtactctatttgatatttcaaacattctctcatttagtgaagaagctcccaaccggagtgctcagaacctacattgcctcacctgtgaagtgagcatgtgggactgaattgcctttgaggtctctttcagctcttaatgatctgttatcccatagtaagatacattatttttaatctcgttggatcttaaacaccaaaaataatagtatttaagacgtaggatgctatcttgtcattattttaatgcacatgtcaacacacgaggttttgctagatgttatgataaagcaagcgaaacagagcaggctactgctcctcaaatatctacagtcaatgaaatattgactggcgttgtgggaaaatatctcaaaagtattttatttacaatttaaaatatattcttttgcctaaagaaacaatgaaacaactataacttgtttttgttattgtgttagtgtagtcatacatatgatacagttttataatctgcttgataagggtacgtctctgggtttttcacactttgcaacaagtgggaaagaacttcgacaaaaacattaaaacattatcaacctggttgcacgtttttctgattattttcagtgctcttaggtttttagaccatatcaaaattctctctctacgcacatgatttataagggaaagaaaagtttgcagtatgcctaaaatgttcctcaggttaattatatcttgttttgcatagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcccctggggatttttttttaaaaaaaaaaaaaaaggagattctgattcaggtgatctgggctgagtacttacagtatgcatttctaataaacttctgggtgttgctactgatattggttcaagaactaaattctgagtaacaagtataaaccgaatgtccataaagtataatttcttttagtatcatatggttataatgcttgcattttgtatatatgttgcatacaggttttgcttttctcttttttcttattaaaaaggttataaaggtacactgtagaaactgtagggagtaggggaaagcttggcatctcatgccaccattcagaggtaaccatgtttggcattttaaaaatgcatttatagtgtgtgtgtgtgtgtgtgtgtgtgtgtgtgtgtgcgcgcatacatatatatgtatgtattatacatatacgttaatatacatataatatacatatattactgtgcaaaagttgataaattgattatgattatgtataaactttgatatcttctcatatttaatataatatagttgtgagcactcttccatatcattaaataactttctagacattttaaatgaatatatagaaaatgaaacatcattaatcagtcccttatcttagaatatttatttcggttatttacaatctattagtagtttaaaagtacttcatggaaaatccttatacatgcatcttagttaacttgaacttttatttttagagaagacatgccaggctgttctaggctattgatacatattgccaattaccttcctgaaagattgtaccactttccacttaggcacagagtgtgaatgcctgttttaattactctatttacatcagtaaagactatatctgaaattatctcatttttggggacaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggtaatcaagcacacattttatcattaataaaaatatgaatgctgaataccatcctccctcctaagcagtcctaccagtgttgctcgccattttattggtcatcccagttgtaactttttatgtgatctgttaacgatctttatctcctattgatacatattctgtcactctccaagtcctatttatg

SEQ ID NO: 9370 - DNA, 3581 bp, Homo sapiens
agtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtgagttgctacaaatgagacatacgtttagttttgttttatagtatatatgaatatgtgtgtacatttttggaattttagtttgattatacaaaatatctttggcttagaaatattaggcatgctatgtaaaaccttactggaaaaataaattgaccaacattattgagagtattttttcaaagtgttccaaaagtaatggaccaatgattactttaaatgaaatcatgtaatggaccacagaattgcaaattactaataaagaaaagccattttgcttattgccatgtaataacatgttgcatgatacaagtagatacgtatgtttatgctgcaacaagtataggtgatactaattgggcaacttttaaacaagaccataaataactgaaatcaaagttcttagtatttatgcagcctgttggtttgcgagggctgccataacaaagtaccacagactgggtggcttaaggaaggttgttttttcacagttttggaggctagaagtccaagattgaggtgttgtcaggtttggtttcttccaaggccacactccttggcttgcagatgtctgcttgcttactgggctcctaaacagtcttttctgattgtcctaatgtcctcttcttataagggcatcagtcatattggattggggcccacccatatgacctaattttaccttaatgacctctttaaagctctgtctccaaatacagtcatatggctgtgatacagggggttagaatttcaacgtatgaattttgagggggacacaattcagactataaactgcagttaatgtttactgttaaattaaatctataactgactaaaccacacaaacaggagatttcaaattagactttattagttttggaaggaagagatgaaatgttgttactttttctgttttatgtagttgtaaaagccactaaaaatgtacatgtacaaatcatcccaagccaggcaacattagtaatgaatgactgcagcacagaggtaagagagatgatttaaaggaggatgaattgtctgcaaaggtgctgggcaagatctagactaattcatccccttcattttaagtttaggttttaaatagctttgtttggcttgatcctagagctacacatttacttttaacttgtttactttgtaccctatcatttaggatatgctatgtactattgtactctatttgatatttcaaacattctctcatttagtgaagaagctcccaaccggagtgctcagaacctacattgcctcacctgtgaagtgagcatgtgggactgaattgcctttgaggtctctttcagctcttaatgatctgttatcccatagtaagatacattatttttaatctcgttggatcttaaacaccaaaaataatagtatttaagacgtaggatgctatcttgtcattattttaatgcacatgtcaacacacgaggttttgctagatgttatgataaagcaagcgaaacagcaggctactgctcctcaaatatctacagtcaatgaaatattgactggcgttgtgggaaaatatctcaaaagtattttatttacaatttaaaatatattcttttgcctaaagaaacaatgaaacaactataacttgtttttgttattgtgttagtgtagtcatacatatgatacagttttataatctgcttgataagggtacgtctctgggtttttcacactttgcaacaagtgggaaagaacttcgacaaaaacattaaaacattatcaacctggttgcacgtttttctgattattttcagtgctcttaggtttttagaccatatcaaaattctctctctacacacatgatttataagggaaagaaaagtttgcagtatgcctaaaatgttcctcaggttaattatatcttgttttgcatagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcacttggggatcttgtttaaaaaaaaaaaaaaaaaggagattctgattcaggtgatctgggctgagtacttacagtatgcatttctaataaacttctgggtgttgctactgacattggttcaagaactaatttctgagtaacaagtataacccgaatgtccataaagtataatttcttttagtatcatatggttataatgcttgcattttgtatatatgttgcatacaggttttgcttttctcttttttcttattaaaaaggtgataaaggtacactgtagaaactgtagggagtaggggaaagcttggcatctcatgccaccattcagaggtaaccatgtttggcattttttaaatgcatttatagtgtgtgtgtgtgtgtgtgtgtgtgtgtgtgtgtgcgcgcatacatatatatgtatgtattatacatatacgttaatatacatataatatacatatattactgtgcaaaagttgataaattgattatgattatgtataaactttgatatcttctcatatttaatataatatagttgtgagcactcttccatatcattaaataactttctagacattttaaatgaatatatagaaaatgaaacatcattaatcagtcccttatcttagaatatttatttcggttatttacaatctattagtagtttaaaagtacttcatggaaaatccttatacatgcatcttagttaacttgaacttttatttttagagaagacatgccaggctgttctaggctattgatacatattgccaattaccttcctgaaagattgtaccactttccacttaggcacagagtgtgaatgcctgttttaattactctatttacatcagtaaagactatatctgaaattatctcatttttggggacaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggtaatcaagcacacattttatcattaataaaaatatgaatgctgaataccatcctccctcctaagcagtcctaccagtgttgctcgccattttattggtcatcccagttgtaactttttatgtgatctgttaacgatctttatctcctattgatacatattctgtcactctccaagtcctatttatg

SEQ ID NO: 9371 - DNA, 1666 bp, Homo sapiens
ctttttttttcatgattggttgcagttttcctacagttctcattaacaggtgctccttgatcactatgacacgcgatgatactttatctctctggttagggttggttatcttaattaattgcttatatttatatttaactgaaactagcctcaagatgccactttattaaagtttgagagtggtaagaaattacaaaactattccattaaaaaaaatagaaaagaaaaccaaataaaccagaagaacatataaactatgattagtcaaatcaaatctctgcatttaaaagtaaacatcatttactagatgtctactggactagaaatatgtgtcttctgaacagtaactgaggagtttctgcaaattattctgcaaattgtaaataggcatctctacctttttattacattaattttatcacacagtatgaagtttttttaaaaacaaagccaatgatgtacatatattcaaaagcacaagattctctgaaaatatagaaaatactgctaggcttattttacgaagacaaaggacaataggaagctgggaagaataccagcaaacagctatacgttataaggcctctgtatcacaaaaatgaagggaaaataaagccaatctaaagtattacgtacttaaattaataaactggattggaagcaatcattccattataaatttcctttcatacatagcaatcccactgagatgatacctttgtaaaatcaggcaaaaatcaattgttaatattctagagatggacaaaccacagattaagtacctaaataatcatgtttccaatcaccaattaactaagtagaattctcttaattgtatctattaaggcctactaattgacagaaaaagggcagagttgaggacttggagaaagaagacagaagcattcctctgcctgattcataaaggtcagaatcccctggccgttgttgtaggaacccagccatcaccagtcacaaagaaaaaggcagcagcacactttgagtatccaaagggcctctttactgaggctgcatggctgttgtgggcttagtccaacatgatgatgtaggacaagaacctaccagttcaatcaacatgcaattaaaactcctgatgaaggacggcccagggcagtccattggtttggggcaggggacgcagagaagcaaagcctgttttaattaagaaaatactaggcactcctctttaaatcctcaaaaaatgaggatgaacaagattccaaaaccaacaatcacaatgtgtgtgaaagtaccagcaacaagaatgaagtgggactgaatatgtgctttcctacaaatgaaacctgtttgatggtgtaaggaaaatggatgagctgtggtcaagaataggccgaggcagacatctagtccagcatgactcagcgagtttggagtgcaggcacacagctctgcctgttatgtaaccatgccatgtgaggtgcattaagtaaccactcatgtgtgctcatgcttgactcggagccactattgtctgtaaaaggtataattaccctgctaatgctgtatgtaacggcttgcacctgtggctcatcctcaggcttgtacccatggcttgcttgtgcccatggcttgcttgcacccacagctcccgtgtgtccagagaataaagccatgttgaaatgcc

SEQ ID NO: 9372 - DNA, 1666 bp, Homo sapiens; identical to SEQ ID NO: 9371

SEQ ID NO: 9373 - DNA, 429 bp, Homo sapiens
catttccatgcacctcacattcgacaggactcaatgtacacgtaacagaggggctacagtggcctggtgccagcaatgtttctttttggcttcacaaactctataaaaatgaagttttttgaagagctaagggaaattattccttaaaaatgtagaaagtgagaatagaagtgctacaatgtccaagggcactcactgaccaggactgagggtccagattcttgttagaggaaagcctgccacatataagacataggcacagtctaactcagtcgttttcaaactcatctcacggcccttttacaggctcacaaatgatcgcagaccctaaagagcttttgtttatgtgagttgtttctatcagtgtttaccatactggaggttaaacccaagaaagttttgcaacatgaagacacaggcacacatccc

SEQ ID NO: 9374 - DNA, 429 bp, Homo sapiens; identical to SEQ ID NO: 9373

SEQ ID NO: 9375 - DNA, 3821 bp, Homo sapiens
ggaaagtttcaccagagcccttttccaccatgacagtgctcctcctgctcattcctctcagcaaacgagagccattttccaagagttttgatgggaaatcatcaggcatccactttgcagtcctgattgggcttcttctgactttttgtttcctaatcttaaaaagctgtaaagggcacccatttctcttcagttcacaatgcagagactacactgacaaggtgaaatttccaggagcctcagttctttagggatagactgaatggttggtattatgtcttatagtagtatcttgaacttgatggaacttatgttgagaaataaagtttatatttttttatttttcttttaattccattttccatgaacttttaaaagtcccctcatacatgtttacagatgtccatagaaacgttattcagatactgaataaacaaccaaaaaaacattgttttatcaatgaggaacctgttaaatctacataatacagctataaaaataattatgtagttctataattaccgacatgaagacatctgagtaaaaacctatttctgatgttatagaagaacaagtatagtacactcttgaatgtaaatttctctgtgtatgcattcatatatactgtacattcagaatcctggaaaggggcttgcacagatgttaccagtgtatgtctcagagtgacagaaggacatatgagttttccttttcccttatacttctttaaaaacacactgattttttttgcacaatgaatatcaatcatattaacatataaagatttaattttttccccagaagaaaacaaaaagattgagctttgtgtaccatccacggacaaaaatgctatgtgttttgcagactcaggtagtagtccctgcgtgtgctgggggtgagatggggaggagccgctgatttctcagcaggccacaccactttcttccctagcaaagctgcacaatgttttcagcagtgtctgcaatgagagctaaatgacctccatctagaacaaatgtaacctgggcacttgctcttccacggatgctcatgagtaaaaggaagctggagttctttacaaaagaagctttgctatgagaaataaaaacaacaaactgttttttacaatttttatttggtgttaactccacaagaaaacaaacaaaaaaaaatcagttactctggtgtacgtgaaatcagaacaatacaaccacgggaaaaacaatctcagcccaggaatggaaactggtacttcagtgctatggaaatgcaatgcgcttcataccacagtgcgtttcagcgtttgccaactttttaaaaatgctttttctttgtgatcatccattcacaaaactaaaaagccacactttcatctctgttgctgaaagcctctgagcttcagctacttaactatgaaaacaaataaatacataatttgtgaatccctttgctcacttcgaatccgtcccattcacctgtggaaggtgctgcatcttctcacctgtgtctgaggaagtgtgcacctttgccacctggagccctttcctaataaacagcagctgtccaaaatcaactgtgctcaaggttgtgtctgaaatctatttatttggtctttgctacacaagcaacgatttctagaataatcgtcactgtagtgatatgaggaatttacaactttcaatccttttttacttttgctgttaaattatatttcagtgcagatgcttatcaatttttaggaagctccagaagaatgaaaaatacataaaaacgtatctgaagttcgtaaataaataacagcaacataaaaccttacacatgcgcgcgcgcacgcgcgcacacacacacacacacacacacccacccaccttaaagtgtcaaaaaatgtgttgtataaaaataaaccctaacacgtgggaagatcgacccggcgggcacaccaggtccctctcggtgaggacacacagaccctcaatgactccacagtctttgatggtactttcttttctgtgttatcaattaagaaaaaggcaacaaaacccaaatgttcaaagcaaatcatagatttcacagccagttcagctcccagctaataaattatatgtgtgtttactgcctgcccaaatgagtggtgaagctgtctagagcgcatcagacttttctgccattcctgatgctccaggcatgctacgctgatttcacagattaggttttttttgtttttgttttttaaacaatgagttggttaaaaaagaaaaacaatgtaaaaaatgtaaaatgtttcggctgtgcacatactgctcctcctggcctctgcctgtggcacaatgccatgagagccggaggagcggatcgccatgcacagacgcgactcacaagatgcgccggctccccgggctcaccaaggagaaacgggagccagtcccacggagcgacagtcagcaaaaccaccacacagggatgtggaaaactcatgactctacccgccccaacccaccacacacagaacttgcccagaacattctctcaaacacaaaatgagatcgaagctatactacatcacagccaagaagcggctagctgcagcagccaaagatttctctgggtgatgaggtggcctttactgcatgtcaaatgttcacaatttcaagttttgggggtttcaattcaacataggtcaccagaaagtaacaatctgtaactaaggtccttagcacgtatggaacactcaccacaaagaaccctgcatggggttttggtgtaaatgtaactgcagtatgagagcaggtaaggggtggggtatgcacccttaccccactgtgtctcgcatacgaccccacaccccaaatccttggcttcttcagttagcaagaaagtcacgaaccatagtatcttccgtgatactttaggggaaaagaaatcctaagagagaaaacacagtatttggtgagtcttgaaaagcacacctctgcggttcctactggaaatgtacatgagattttgctgaatggagaccaccgctgagtcacccaggcttccctctcgccttcagaaaggcatcaagccactgtagggtaagaatggatatcccagttcttggagaacaaagcctaaatgctccaaagctgaagtctctgaagagcagaagtggttgttgacactgcaatgctagtaaggtcatagtgatataaccgcagtcggaaggaaaattaactgcagttaagatgcaaaaagcagtgatacttctaagacaagcacatgcacacccattcttgatttgacaacacaatctagtctatttcaaatagccaagaatttaacagctgggaaaaaaaatctttaacaggatagctgtcctcaactctaaaataagcaagaagagaaagataattattaccaatctgaatcagttaattgaagaggaaacctaagttgttgttttagattaacaggtctcactgaagagtaattttccatcacatatcatttttaaacaataatttgtactattttgcaggtttagagatgagttcgagaaaagagctcctcttcactagggcccacccactcgcctccgccttctgagcctgtctcttccgaggtggagctggcgctggagcacatctttccgcggaagccatctgactttgctccagaatctctctctcctgtacatcttgcttcataaacagaagacacctaagattaaaacaattttcaacacatcaaaaagacttttttttccccaaaagggtgagatactctatctatatacaaagaagaaataataaatcatcagtgttttcctgtggagttacaaa

SEQ ID NO: 9376 - DNA, 3817 bp, Homo sapiens
ggaaagtttcaccagagcccttttccaccatgacagtgctcctcctgctcattcctctcagcaaacgagagccattttccaagagttttgatgggaaatcatcaggcatccactttgcagtcctgattgggcttcttctgactttttgtttcctaatcttaaaaagctgtaaagggcacccatttctcttcagttcacaatgcagagactacactgacaaggtgaaatttccaggagcctcagttctttagggatagactgaatggttggtattatgtcttatagtagtatcttgaacttgatggaacttatgttgagaaataaagtttatatttttttatttttcttttaattccattttccatgaacttttaaaagtcccctcatacatgtttacagatgtccatagaaacgttattcagatactgaataaacaaccaaaaaaacattgttttatcaatgaggaacctgttaaatctacataatacagctataaaaataattatgtagttctataattaccgacatgaagacatctgagtaaaaacctatttctgatgttatagaagaacaagtatagtacactcttgaatgtaaatttctctgtgtatgcattcatatatactgtacattcagaatcctggaaaggggcttgcacagatgttaccagtgtatgtctcagagtgacagaaggacatatgagttttccttttcccttatacttctttaaaaacacactgattttttttgcacaatgaatatcaatcatattaacatataaagatttaattttttccccagaagaaaacaaaaagattgagctttgtgtaccatccacggacaaaaatgctatgtgttttgcagactcaggtagtagtccctgcgtgtgctgggggtgagatggggaggagccgctgatttctcagcaggccacaccactttcttccctagcaaagctgcacaatgttttcagcagtgtctgcaatgagagctaaatgacctccatctagaacaaatgtaacctgggcacttgctcttccacggatgctcatgagtaaaaggaagctggagttctttacaaaagaagctttgctatgagaaataaaaacaacaaactgttttttacaatttttatttggtgttaactccacaagaaaacaaacaaaaaaaaatcagttactctggtgtacgtgaaatcagaacaatacaaccacgggaaaaacaatctcagcccaggaatggaaactggtacttcagtgctatggaaatgcaatgcgcttcataccacagtgcgtttcagcgtttgccaactttttaaaaatgctttttctttgtgatcatccattcacaaaactaaaaagccacactttcatctctgttgctgaaagcctctgagcttcagctacttaactatgaaaacaaataaatacataatttgtgaatccctttgctcacttcgaatccgtcccattcacctgtggaaggtgctgcatcttctcacctgtgtctgaggaagtgtgcacctttgccacctggagccctttcctaataaacagcagctgtccaaaatcaactgtgctcaaggttgtgtctgaaatctatttatttggtctttgctacacaagcaacgatttctagaataatcgtcactgtagtgatatgaggaatttacaactttcaatccttttttacttttgctgttaaattatatttcagtgcagatgcttatcaatttttaggaagctccagaagaatgaaaaatacataaaaacgtatctgaagttcgtaaataaataacagcaacataaaaccttacacatgcgcgcgcgcacgcgcgcacacacacacacacacacccacccaccttaaagtgtcaaaagatgtgttgtataaaaataaaccctaacacgtgggaagatcgacccggcgggcacaccaggtccctctcggtgaggacacacagaccctcaatgactccacagtctttgatggtactttcttttctgtgttatcaattaagaaaaaggcaacaaaacccaaatgttcaaagcaaatcatagatttcacagccagttcagctcccagctaataaattatatgtgtgtttactgcctgcccaaatgagtggtgaagctgtctagagcgcatcagacttttctgccattcctgatgctccaggcatgctacgctgatttcacagattaggttttttttgtttttgttttttaaacaatgagttggttaaaaaagaaaaacaatgtaaaaaatgtaaaatgtttcggctgtgcacatactgctcctcctggcctctgcctgtggcacaatgccatgagagccggaggagcggatcgccatgcacagacgcgactcacaagatgcgccggctccccgggctcaccaaggagaaacgggagccagtcccacggagcgacagtcagcaaaaccaccacacagggatgtggaaaactcatgactctacccgccccaacccaccacacacagaacttgcccagaacattctctcaaacacaaaatgagatcgaagctatactacatcacagccaagaagcggctagctgcagcagccaaagatttctctgggtgatgaggtggcctttactgcatgtcaaatgttcacaatttcaagttttgggggtttcaattcaacataggtcaccagaaagtaacaatctgcaactaaggtccttagcacgtatggaacactcaccacaaagaaccctgcatggggttttggtgtaaatgtaactgcagtatgagagcaggtaaggggtggggtatgcacccttaccccactgtgtctcgcatacgaccccacaccccaaatccttggcttcttcagttagcaagaaagtcacgaaccatagtatcttccgtgatactttaggggaaaagaaatcctaagagagaaaacacagtatttggtgagtcttgaaaagcacacctctgcggttcctactggaaatgtacatgagattttgctgaatggagaccaccgctgagtcacccaggcttccctctcgccttcagaaaggcatcaagccactgtagggtaagaatggatatcccagttcttggagaacaaagcctaaatgctccaaagctgaagtctctgaagagcagaagtggttgttgacactgcaatgctagtaaggtcatagtgatataaccgcagtcggaaggaaaattaactgcagttaagatgcaaaaagcagtgatacttctaagacaagcacatgcacacccattcttgatttgacaacacaatctagtctatttcaaatagccaagaatttaacagctgggaaaaaaaatctttaacaggatagctgtcctcaactctaaaataagcaagaagagaaagataattattaccaatctgaatcagttaattgaagaggaaacctaagttgttgttttagattaacaggtctcactgaagagtaattttccatcacatatcatttttaaacaataatttgtactattttgcaggtttagagatgagttcgagaaaagagctcctcttcactagggcccacccactcgcctccgccttctgagcctgtctcttccgaggtggagctggcgctggagcacatctttccgcggaagccatctgactttgctccagaatctctctctcctgtacatcttgcttcataaacagaagacacctaagattaaaacaattttcaacacatcaaaaagacttttttttccccaaaagggtgagatactctatctatatacaaagaagaaataataaatcatcagtgttttcctgtggagttacaaa

SEQ ID NO: 9377 - DNA, 435 bp, Homo sapiens
cttctctgatccatgaaggatccaaaatcctaattccacatgttcagtcacttggacaaaatgttagccatgttagggtaggataaagaattatttcattttcaaagtctttgagtacctgctatgcaccaggaactttactgggcacagggactccagcagtggaaggcgcatgccaggctcgctggggagatgaacgagcaaaccaacatgtgccagttgcagtgacacagtaccgatggtgaggggggcactgcagacgggtgtgttgggaagggagtttgcagtgacacagtacagatggtgaggcgacactacagacctgtgtgttgggaagggagtttgcagtgacacagtacagatggtgaggggacactgcagacctctgtgttgggaagggagtttgcagtgacacagtacagatggtgaggggac

SEQ ID NO: 9378 - DNA, 538 bp, Homo sapiens
gatcatgccactgcactccagcctaggtgacacagtgagactgtctccaaaaatgagctatgcacagatttcaaaaattttttgcaccaaaataaacttgtactaacttgttataacatgtcttaagatctactttgaggcactaagaagggtatgactgtttgaaaagagcacctatcagagcaacatgaattctgctaaaaatggaagcaaggacatcaaatttatggtgatgcttgggtggaagaatggtgagatcagtgatttttttttttttttttcctgagacagagtctcgctctgttgcccaggctggagtgcagtggcgtgatctcggctcactgcagcttccgcctctcaggttcaagcaattctcttgcctcagcctcctgagtagctgggactacaggcacatgccaccacgcctggctaatttttttgtatttttaataaagacagggtttcaccatgttggccaggatggtctcgatctcctgacctcgtgatccacccacctcagcctcccaaagtgctagga

SEQ ID NO: 9379 - DNA, 435 bp, Homo sapiens
cttctctgatccatgaaggatccaaaatcctaattccacatgttcagtcacttggacaaaatgttagccatgttagggtaggataaagaattatttcattttcaaagtctttgagtacctgctatgcaccaggaactttactgggcacagggactccagcagtggaaggcgcatgccaggctcgctggggagatgaacgagcaaaccaacatgtgccagttgcagtgacacagtaccgatggtgaggggggcactgcagacgggtgtgttgggaagggagtttgcagtgacacagtacagatggtgaggggacactgcagacctctgtgttgggaagggagtttgcagtgacacagtacagatggtgaggcgacactacagacctctgtgttgggaagggagtttgcagtgacacagtacagatggtgaggcgac

SEQ ID NO: 9380 - DNA, 443 bp, Homo sapiens
gatcatgccactgcactccagcctaggtgacacagtgagactgtctccaaaaaggagctatgcacagatttcaaaaattttttgcaccaaaataaacttgtactaacttgttataacatgtcttaagatctactttgaggcactaagaagggtatgactgtttgaaaagagcacctatcagagcaacatgaattctgctaaaaatggaagcaaggacatcaaatttatggtgatgcttgggtggaagaatggtgagatcagtgatttttttttttttttccctgagacagagtctcgctctgttgcccaggctggagtgcagtggcgtgatctcggctcactgcagcttccgcctctcaggttcaagcaattctcttgcctcagcctcctgagtagctgggactacaggcacatgccaccacgcctggctaatttttttgtat

SEQ ID NO: 9381 - DNA, 335 bp, Homo sapiens
gggattgacagccacctgtgaagactcacctgctaggatctggctggctgtcttggtcgctgatcatgtccgaagaagtacaccactttcttaatcatgcagcttttaaaaatctcctcagccccacacttgagggtctctctcctagattctaatgtctagccctacacgaatgcagtatgctgcccttgatgtgataggacaacagaggacctgcacacatgctactggtcctgactgtgttttccttccataaacactgttctggcaagctggttttatgtgctgctggaccatttgcttatgtttgcacaataaaccagaaattaaacttt

SEQ ID NO: 9382 - DNA, 335 bp, Homo sapiens; identical to SEQ ID NO: 9381

SEQ ID NO: 9383 - DNA, 335 bp, Homo sapiens; identical to SEQ ID NO: 9381

SEQ ID NO: 9384 - DNA, 315 bp, Homo sapiens
tacttttttttttttttgagacggagtctcactctgtcacccaggctggagtgcagtggcacaatctcctcttactgcaagctccgcctcccgggttcacgccattcttctgcctcagcctcccgagtagctgggactgcaggtgcccgccaccacgcccggctaactttttgtatttttagtagagacggggtttcaccgtgttagccaggatagtctcaatctcctgacctcgtgatccacccacctcggcctcccaaagtgctgggattacaggcgtgagccaccgcgcccggccagtgatatacttttaaa

SEQ ID NO: 9385 - DNA, 400 bp, Homo sapiens
cagatttatacatatttaacttgaagatttttgttcaaacttataaataaaagcaacatatgtgtgaagcagtctgcaataaattgtagcattgtgatatgagaactggttttaaattttgcaaattaatattttatttaacatttgaattgcttaaattgatataaaactgctttttaaaaattgtattacctttctgctagaattcattcttgtacttaattaaatctttttggcagtttccagtttcaagaattccatgcatgttcacagacatcattttctgtactgtaaagcatttgtttcttgatttgctgagttgaagtattcaatttaagtcattagctaaacagaagtcctcagtttatgctaatattgttttgtcataatgtcaatcagc

SEQ ID NO: 9386 - DNA, 295 bp, Homo sapiens
ttttttttttttttgagacggagtctcactctgtcacccaggctggagtgcagtggcacaatctcctcttactgcaagctccgcctcccgggttcacgccattcttctgcctcagcctcccgagtagctgggactgcaggtgcccgccaccacgcccggctaactttttgtatttttagtagagacggggtttcaccgtgttagccaggatagtctcaatctcctgacctcgtgatccacccacctcggcctcccaaagtgctgggattacaggcgtgagccaccgcgcccggcc

SEQ ID NO: 9387 - DNA, 400 bp, Homo sapiens; identical to SEQ ID NO: 9385

SEQ ID NO: 9388 - DNA, 7280 bp, Homo sapiens
atggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 9389 - DNA, 7293 bp, Homo sapiens
ggagtggctcccactcctgctgcttctgactcaatacttaggggtccctggtgagtgcccccaaccctgatccccatctgccttcaggagggggttggccctattctcctattctgggatgagaaaaaagtcggggagccagaggctcagtgggcatggggcagtgaccttggcctcttgagcacagctgggaagccctaggaacacacagacacggcccacttaggcctctattagcacgtctgctctagcactgaagcagtgttaggaccacacagatgcacgcacacagcaggaaatgacccctcctgagcctgatctacccctctaacctagcgtatgcctttgtgcaggtgagagcccagatttggagtctgaatgcctagccagggcccctggctgggtaatgtgatggctctgagccttagcattctcatttgagagatgagatggggcaagctccatcacccactgctctcacagagcgtatgtgttagatctgagcccagtgcctgggccactacacagaggcaccggtgataactaccaagtctgggcctgcttcccaggggaaatttttttgacaagtatctgtgcaggggggctagactggcccttgaaagtgcatacagggtccatcccagaagccttgtagctttgatcccctgaatgaacaaagtgtggacatgccaatacacattactgacatgtatgcccacctgacctgcacccactcatgcccactctgcagggcagcgctcgccatcgaatgacttccaggtgctccggggcacagagctacagcacctgctacatgcggtggtgcccgggccttggcaggaggatgtggcagatgctgaagagtgtgctggtcgctgtgggcccttaatggactgctggtgagtggccactgggcctagataagactgggggcaggggagcctgggccgtggcgttaccctgtgccttcttctctccagggcgttccactacaatgtgagcagccatggttgccaactgctgccatggactcaacactcgccccactcaaggctgtggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcacaagtgagacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcagcatcaaatcctgccgggtgggtaagcggcgccgggtcaagctgggagagtggaggggcaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtaccagggtcttcttcacgccccattaccgcccccaggttcctcgaccaaggtctggacgacaactattgccggaatcctgacggctccgagcggccatggtgctacactacggatccgcagatcgagcgagagttctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcggcgtaccttgccagcgttgggacgcgcaaatcccacatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcaccctgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacatttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccttacctcagccctcaccaccaaaggctggctcccttaaccccagtgaactttgtctttcagctgatgaccagccgccatcaatcctggacccccccaggttacgagttgggccagttatgggtcaggccctttagcccacgacatccacacagtctgggtttcatccagcccaccccatcctacagaccaggtgcagtttgagaagtgtggcaagagggtggatcggctggatcagcgtcgttccaagctgcgcgtggctgggggccatccgggcaactcaccctggacagtcagcttgcggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcgcggggtctctagtaaaggagcagtggatactgactgcccggcagtgcttctcctcctggtgagcctcccttgtgtttggggacccagtctcatcccactttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagaggtatgtggacaacctgggaggatgtgaggtggggctgagccttgtggcctcagaccctgagtgcccccattcttgttaaagatctgtgaccctgaaccagcgtgtggccctgatctgcctgccgcctgaatggtatgtggtgcctccagggaccaagtgtgagattgcaggctggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcattgctgtggcccggggccctcatcagttctcctacctgccagggtgactacgggggcccacttgcctgctttacccacaactgctgggtcctgaaaggaattagaatccccaaccgagtatgcacaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaacaaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaaggtatttcatagaaaaatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtaaagtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgttcgttttatagttccaggccagcacctagaacctggctagaataaaaaactgcagaaatcatgagtttcttgtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 9390 - DNA, 663 bp, Homo sapiens
aggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccggggccctcatcagttctcctacctgccagggtgactacgggggcccacttgcctgctttacccacaactgctgggtcctggaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgctttt

SEQ ID NO: 9391 - DNA, 3374 bp, Homo sapiens
cttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtgcagcgcctgcttagagaccttcgggagaacttctgccggaacctcgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgctggtccgctgagacgccgcacaagccgcagtgagtccctggtgctcccggccccgccagggccctaaccctggggcggcatgctttggtgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagcccccaccaccaaaggctggctcccttaaccccagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgtcgttccaagctgcgcgtggctgggggccatccgggcaactcaccctggacagtcagcttggggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgtttcctgtcctaattccccactcctctaggcagggccagcatttctgcgcggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagaggtatgtggacaacctgggaggatgtgaggtggggctgagccttgtggcctcagaccctgagtgcccccattcttgttaaagatctgtgaccctgaaccagcgtgtggccctgatctgcctgccgcctgaatggtatgtggtgcctccagggaccaagtgtgagattgcaggctggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaacgtcatctccaaccaggagtgtaacatcaagcaccgaggacatgtgcgggagagcgagatgtgcactgagggactgttggcccctgtggggccctgtgaggttggtagcagggccctgggccagccctggaagggtatggggggctagaaatgaactattttatcatgaagcaggctagtcattgctgtggcctggggccctcatcagttctcctacctgccagggtgactacgggggcccacttgcctgctttacccacaactgctgggtcctggaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttttaagtacagtcaacgacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccacaagaaataaattacttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgttt

SEQ ID NO: 9392 - DNA, 496 bp, Homo sapiens
taaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatc

SEQ ID NO: 9393 - DNA, 373 bp, Homo sapiens
ctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatg

SEQ ID NO: 9394 - DNA, 496 bp, Homo sapiens
taaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttctggaatgctttagaaatttagcagttatcttttttatgtattttacatttgttacagctttccttggtggacagatatgagttttctacttgaaaataaacacgtttttctttaaaatatc

SEQ ID NO: 9395 - DNA, 760 bp, Homo sapiens
gctgatgaccagccgccatcaatcctggacccccccagttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctca

SEQ ID NO: 9396 - DNA, 310 bp, Homo sapiens
aagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcc

SEQ ID NO: 9397 - DNA, 1522 bp, Homo sapiens
tggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccatttttatacttctggggcctcagaaaatattctcagctattctgttagattgatctcctaccatctgagagggggcttccttcaaacaaccaaatttccaggtatttctaaactgcccttcccctacaccattctttgattcagtatttcaagacccctaagagaaatggtacatttacatgtaagcacaggatagtgaagtatttacaaaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgcgagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagaaaaatgaccttatttttaaatagagggggcagttgaaaatcagtgaacgggcctaccccctaatgatttttttctcagacataattataataattagcattataaagtgctaattatctttggacacagaggacctgcacaccagagacagaggtccgcattaagtaaagtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatt

SEQ ID NO: 9398 - DNA, 1017 bp, Homo sapiens
cgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctttaa

SEQ ID NO: 9399 - DNA, 336 bp, Homo sapiens
atgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctat

SEQ ID NO: 9400 - DNA, 3608 bp, Homo sapiens
cagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgaggtgagggtgcacccagagcagattcgttcccgatgcaccagggcctgtgctgggtgttccgcacttgacttcatttaactctcacaaaccctgagggaagtgccggtgacctagttagagatgagaaaactgaggtcagagctgtgaagtaacagctgagatacccctgctggtaagtggcagagccgggatgcaagcctggaccaatggacttcatctgggtgcccagttctgctcagggcccactctgccctgatgcaccaagtatagtcatgtggaaccaggattcaatggaacaggaggctctgtgtctacacggattgaagaattgtagtgcagcaatgataaatgaaattagatcatttcagagtgcatgtttacaattaggaccttactctggtactttaaaactgctttgatatggaattggatgaatgtacatttttatcttttttttgattctgacccattcattgctgcaaaacacaacaaccttttccttctagaggctggaatcatagacactgaaacactgatgtttataaagttctgtaatagtgaaaactcagcttatccatcaagagaaggttgtaactttttgatgtcttcttttacagctgtgtcaaggaaagggctttatttgtgaattttgccagaatacgactgtcatcttcccatttcagacagcaacatgtagaagatgttcaggtatttaataacttaataacataagcttaataataggttaactaattaaactaagtttagtaacttaagcacaaaattaacttaagctgaataatagcttaataatttaagcacagttatttaaagtacagtcatgctggtgtgtgcttgtatgctggattggagataatgaagttttgggcacagaaggaggagtatttgggtggggcagggataaaggataatgtcttctggtgcagggtttggatagaggagatggtccctttgttgcctgtgcccacctctctgtcttgtaattggatcattcatgcccagtggtgaagtctctggctgcttttgtgccacggaggcagagttgagtagctgttgtagagaccacatggccctcagggtctaaaacatttgctatctggctctttacagaaaaggttgccgacccttctgtggtattagtgcccgagagaatcccgtgttctgtaaactctgtttaatgggagagatcctggtaatgaactctgccttcacccttgataggggcatatcctcctctcaggccactccagtgttgtctccccaaccctttaggcagtgttgcaggactggctccccagcaaagagactctggggcagagacttgcctacaaaaagtttcatgttcttcaacttaatacctgtaggggtgtgcaggcagcaagactgggagagggagaagttgaactgtggtggggttgcagtggagccctcagctcatctcacggggagctctggagtttggtggcctttcagcattgttccaaactggggacaaattggggccggcctactcactatatagtgatcagtcattgaatgcaggctggtgccaggaaggggacaaagcagctttctcgatgtagggccatatctagagaaacaatgtggcttcccaagagttatcagccaccacctctcttggcagctggggaaacgcctgcctcagtgcttgagcagatccagggggcactgcagtgtccgttacatcaggctctctgagcctcctgttcatgacctgttggaagagtccaacaggtctgctgaaatgtgacctgctgaaacgtgcgtttcagcctggctggtttctttttagaagactctgggctctggattcagacccctctccctccctaggatggagacgaatgtctgcagaaatgtgagaaaacaagatagaccgtttgctaacggctctcttccttgcttgcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacactgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaacaa

SEQ ID NO: 9401 - DNA, 8184 bp, Homo sapiens
ttttcaatttgctgagcatcggccaaagcctgtatgcgaaagccaaggagctggacagagtgaaggtgagccgcagccccaaccccatccctctcattggaagtgtcctgtggcaggaaatgcacatcacactagcttggggaacccacagatacatcctctaagaggcaaatggatcataaagcgagtgaagcggctgggcgcaggggctcacgcctgtaatcccagcactttgagaggccaaggtgggcggattgcctgaggtcaggagttcgagactagcctggccaacatggtgaaatcccatctctactagaaattaaaaaaaaaaaaattagtcaggtatagtagcacacgcctgtaatcccagctactcgagaggctgaggcaggagaatcgcttgaacccgggaggtggaggttgcagcaagccgagattgcactactgcactccagcctgggtgacagagcaagaccctgtctcaaaaaaaaaaaaaaattagtgaagcttacactttggagcccctctcctgcacaggctctttccaaggccccacactgaatcttatacttagtattatgtttttcttgaagaaggccccaaagttctgtaagttttaggttctacaaaacctggatccatccagggcacactttgtggatcagcagactcagttgtgaaggcttgctgtataggcggtttgctttcaaggtttgttttatacaagtgcagcatttcaagcttagaaataacatttaaatttgacttgcacttttcccgtgtcatttattacatttaacttttccccgtgtttggtttctcccattaggaaattcaggagcagctcttccatatcaagaagctgttgaagacctgtaggtttgctaacaggtactattctcagctgggacaggctgccttccctccatacatctgctaatcctattagtgcctcctgcatctggctcccccattacacagggcttcttagcacagtgatgacctcatggctttccttgggaaatcatgccatctctttgaattactaagccaatagtgggatgcattagtctgttctcaagtagctaataaagtcataccagagattgggtaatttataaaggaaagaggtttaattgactcacagttttgcatagctggggaggcctcacaatcatggtagaaagtgaacaaggagcaaaagcacgtcttacatggtggcaggcaaagagagagcatttgcaggggaactctcctttataaagccatcagatcagccaggcacagtggctcacacctgtaatcccagtactttgggaggccgaggtgggtggatcacgaggtcaagagatcgagaccatcctggccaacatggtgaaactctgtctctactaaaattacaaaaattagctaggcgtggtgctgcatgcctgtagtcccagctacttgggaggctgaggcaggagaatcgcttgaacctgggaggcagaggttgcagtgaatcaagatcgcaccactgaactccagcctagagacagaacgagattccgtctcaaaaaaaaaaaaaaaaaatcaaatctcgtgagacttattcactaccatgagaacaacacaggaaagacgtgcctcatgattcaattacctcccaccaggctccttccatgacatgtgggaattatgggagctacagttcaagatgagatttgggtggggacacagcctaaccgtataatggagaatttaactcattaagaagaatggtttagttggaggatgaacaactctagccagtgacctttttattattattattgttatcattaaattgtggtaaatacatataaaatttaccatcttaaccatttttagaatacacttcagtggcattaaagtattaacatcgttatgcaatcatcaccaccatgcagcccccaaactcttttcatcttgcaaaactaaaactctgtatcatttaacaactccccattccctcttcctcttagcctaactcctggcagccactattctactttctgtctccatgattttgcccacacacatgccttatataagaggaatcttacagtatttgtctttttgtgactggcttgtttgacttagcataaagtcctcaaggttcattcatgttgtagcatgtgtcagaatttccttccttctttttttttgagacggagtctccttctgtcgcccaggctggagtgcagtggcgcgatctcggctcactgcaagctccgcctcccgggttcacgccattctcctgcctcagcctcccaagtagctgggactacaggcgcccgcaaccacatccggctaattttttgtgtgtttttagtagagacagggtttcatcatgttagccaggatggtctcgatctcctgacctcgtgatctgcccgcctcggcctcccaaagtgctgggattacaggcatgagccaccgcgcccagccagaatttccttccttcttaagtttgaataatatttcattgtatgtatatactacatttttttaatccatctattcatccgtggacactagggttgcttcccctccttggctattgtgaataaagtggatatgaccatgagtataccaggggccttttaaaaccccttatagggaggcatgtctaaccaagtggaaccatggtcttcaaaaattgtacttttggaagtttatcctaaggacataccgatggatataggtagagatttaaagtatagttttttttgttgtttttggttttgttttaagacagagtctagctctgtcacccagtttggcgtgcagtggtacagtcttggctcactgcagcctctgcctcccaggttcaagcgattctcgtgcctcaccctcccaagtaggtgggattacagacatgtgccatcacacctggctaatttttgttatttttagtagagacaaggtttcaccatgttggccaggctggtcttaaactcccgacctcaggtgatccgcctgcctcagcctcccaaagtgctggggttactagttttgtttttaaataagaaaaggcattaaaagtctattaagaggtattatgctctctccctgggtgatgggatcattgatactccaaacctcagtgtcctgcgatatacctgtgtaacaaacctgcacacatacccccaaatctaaaataaaagttgaaattattttaaaaatctaggtgttcgtaatagggcagtacttacattaataccatgtccgtagaatagaatactatacaaccagtaaagacttaggcatgaattcattgagagagagatttttaagtagaaaaagcataggttgctcaaggaagttaagattgtttattgtacttggtggaattatagagtttttaaataaatggtttagctttaaagcgttttttttcagtctctaatctttaatgatgatgtattgctttttaattaaattttgggggaaggagcatgtattctggagtcatttggttttgagcctttgcttcatggccttggcatggcattggtctcagggcctcggtttttgcatccacaacatagaacaatacctatacttcctaccttgtacaaaaaatcttgaatatccattctgggcttcagataaaaaaaattagtagatctgtattaagtccagggggatggtcagcaccaaccgatcactgctggactgagtgttagacacgtgtcgggggaccatgaggatacaaacggaggcagcatttagctcagttaggagtgagatagggtagaccgcaagcaaggattccaggagaaaaaggctgagcttgaagagtaaggtggagcaaagaagagggattggggattctccaggcagaggatgccgcaggagtgggcacctcaggctgggtgcagaattgaagagaatttggcattgtagcatgccaagtccagtgtaggccatggctgtcttggaagtgcagggaatagtgcttctactagccattgagagaattcaggtcgacacctgccgggtttggagaagatgaagttttgaatgccctagggaccatgaccactggcagttggctgcatgagccttaagctcagtgcctgactcgtgcatttggaagtcataggcttgccgagtgagtgagaattttcgcagctgagccaacagtccataaggctgatagacttgaaatgtagctggaagaaataaggtaggattttgatttcttgggtaatcaaaggggtctaggttcacattctttaagacctaaaaactaatggtcagttttcgtttgctcaatgtgtgcatgggcaggctgtaaaagaaacaggtctctgcttattcagctttttgaaatcagctttcatggaattttaactttcctggcttccaagcaaacttgcaacatgtagaatggtggcgagcatggttcactgttgttcttggagctatttattttttaaattgagttaaaaaaaaattaagtgtgagtgccaagagaaaacaactggccccattcttccctgtcctctgtgtgggtgggtttctgcattcctctttgtttcctctctggcagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgaggtgagggtgcacccagagcagattcgttcccgatgcaccagggcctgtgctgggtgttccgcacttgacttcatttaactctcacaaaccctgagggaagtgccggtgacctagttagagatgagaaaactgaggtcagagctgtgaagtaacagctgagatactcctgctggtaagtggcagagccgggatgcaagcctggaccaatggacttcatctgggtgcccagttctgctcagggcccactctgccctgatgcaccaagtatagtcatgtggaaccaggattcaatggaacaggaggctctgtgtctacacggattgaagaattgtagtgcagcaatgataaatgaaattagatcatttcagagtgcatgtttacaattaggaccttactctggtactttaaaactgctttgatatggaattggatgaatgtacatttttatcttttttttgattctgacccattcattgctgcaaaacacaacaaccttttccttctagaggctggaatcatagacactgaaacactgatgtttataaagttctgtaatagtgaaaactcagcttatccatcaagagaaggttgtaactttttgatgtcttcttttacagctgtgtcaaggaaagggctttatttgtgaattttgccagaatacgactgtcatcttcccatttcagacagcaacatgtagaagatgttcaggtatttaataacttaataacataagcttaataataggttaactaattaaactaagtttagtaacttaagcacaaaattaacttaagctgaataatagcttaataatttaagcacagttatttaaagtacagtcatgctggtgtgtgcttgtatgctggattggagataatgaagttttgggcacagaaggaggagtatttgggtggggcagggataaaggataatgtcttctggtgcagggtttggatagaggagatggtccctttgttgcctgtgcccacctctctgtcttgtaattggatcattcatgcccagtggtgaagtctctggctgcttttgtgccacggaggcagagttgagtagctgttgtagagaccacatggccctcagggtctaaaacatttgctatctggctctttacagaaaaggttgccgacccttctgtggtattagtgcccgagagaatcccgtgttctgtaaactctgtttaatgggagagatcctggtaatgaactctgccttcacccttgataggggcatatcctcctctcaggccactccagtgttgtctccccaaccctttaggcagtgttgcaggactggctccccagcaaagagactctggggcagagacttgcctacaaaaagtttcatgttcttcaacttaatacctgtaggggtgtgcaggcagcaagactgggagagggagaagttgaactgtggtggggttgcagtggagccctcagctcatctcacggggagctctggagtttggtggcctttcagcattgttccaaactggggacaaattggggccggcctactcactatatagtgatcagtcattgaatgcaggctggtgccaggaaggggacaaagcagctttctcgatgtagggccatatctagagaaacaatgtggcttcccaagagttatcagccaccacctctcttggcagctggggaaacgcctgcctcagtgcttgagcagatccagggggcactgcagtgtccgttacatcaggctctctgagcctcctgttcatgacctgttggaagagtccaacaggtctgctgaaatgtgacctgctgaaacgtgcgtttcagcctggctggtttctttttagaagactctgggctctggattcagacccctctccctccctaggatggagacgaatgtctgcagaaatgtgagaaaacaagatagaccgtttgctaacggctctcttccttgcttgcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacactgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgactctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgggtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaacaa

SEQ ID NO: 9402 - DNA, 381 bp, Homo sapiens
tctaatctttaatgatgatgtattgctttttaattaaattttgggggaaggagcatgtattctggagtcatttggttttgagcctttgcttcatggccttggcatggcattggtctcagggcctcggtttttgcatccacaacatagaacaatacctatacttcctaccttgtacaaaaaatcttgaatatccattctgggcttcagataaaaaaaattagtagatctgtattaagtccagggggatggtcagcaccaaccgatcactgctggactgagtgttagacacgtgtcgggggaccatgaggatacaaacggaggcagcatttagctcagttaggagtgagatagggtagaccgcaagcaaggattccaggagaa

SEQ ID NO: 9403 - DNA, 147 bp, Homo sapiens
gagagaagagagaagatgcagggaagaaaaaaagcagaggttggggtgatgcatctacaagccaaggagcaccaagaattgctggcagcccccagaagccggagagaggcagggggcagattcttcctcagagccttaaaaaaaaaa

SEQ ID NO: 9404 - DNA, 147 bp, Homo sapiens; identical to SEQ ID NO: 9403

SEQ ID NO: 9405 - DNA, 2913 bp, Homo sapiens
ggagagctctctgaggttattctcagcttcagccccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactggtgaggggacaaaaggcatgaggggacccctttcaagccccttatttttcttctccctcccccagcccagcttccaactcatctgctttctccttgcttttcccaacatgaattgcagccccagccagtattccaggtgttatagtttgcctgcaagagatgatgcaaggtcctagctcccgccctccctctggctgctcactaggcctgtgggtggagagaggatgttgctctgccagccagggatccagcatatgcagcaagggaccccatggccccctcagcctgcaaagctccacctgttccatccatcttctccctgttcatgaagccaccacccaccttccttacccattggaaactccttttatggccctccttcaactcaattttgtcactgtagggcctgcaggagaggctgggcccccagggcctcctgggctgcagggacccccaggccctgctggacctccaggatcaccaggcaaggacgggcaagagggccccatcgggccaccaggtatgtgcactgagacccttgctgcagtcagggttgccactgccccctccaaccctgacccccgctggcagccccaggcttgacattccactctgaacttgacaaggggaattgggtactacctgaccgataagggaaaatcagaggaaagtgaggaggaactgtgatagtcactgtgtttggttaatgggtattaggaggctaatggataatgttggccccactgcagtactggagactaaagctgagtctattatagctgtctggggtgtgaaaggctgggatggcccagcagttgaacagaatggaccctacctattcctgtttttcttgataccccaattcctgctttgaagtccacgtagcaccgagcacaacaggagagcctcagcagatgtttgctgagtgacttagtgagagctgctttatttctcactgctccctttcctcttctcacaggtcctcaaggtgaacagggtgagtgcctttcatttgattctggagggagaagtgactaggggttggaggatagaggtcctcgggcagccctgggctggggatccagcaggggaagggggctggcactctgccctgagcatcccctttaacatccacccttcccactcaggagtggagggggcaccagcagcccctgtgccccaagtggcattttcagctgctctgagtttgccccggtctgaaccaggcacggtccccttcgacagagtcctgctcaatgatggaggctattatgatccagagacaggtagtcctgggaggggctgggttgaacggttggagaaatgggtgaggtgtgcagtgatatcttcccattcttgccttttccgacagtgtgaatcttcattctctgatttggggagaccccggctctttcttcatttattcattctcaggcagtggggagaagaagtagtcattcattcattcagcagatctttactggggcctgctcctgcccaggcactgttttaagtgctgggaatgcatagtgaacaaagcccccagttccctgccgctcacattccagtgaggtgaaaagacccagagggtccctcctcagtccaggagttctggtgcgctccccggagcttccctggcccccctgactgctatccttgtccccaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgcgcgccgcccaccgccatactaaacgatcgaggaataaagacacttggtttttctaaaaaaaactaaacgaaccgt

SEQ ID NO: 9406 - DNA, 2984 bp, Homo sapiens
ggtcaacactttctcagtggtctcttggcaatggcaccccagtcacaagtaaaggaggagactactttgtcttttactcccatggactccaggcctctgcatggcagttctggatagaagtgcaggtgccaatttcccagcattgtttgtttcattgattaggttcccaggtggtatttagcaagaaccttgggttcagtattctggcttctgagaactggagaactaattgattttctctggcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatatac

SEQ ID NO: 9407 - DNA, 708 bp, Homo sapiens
tgaacaacttctaacctaatactcctcttcttcttttagggccaataaagtcaagatgcagttatggctatttacatttgtttttagccaagatgcagttacgactctttttaaattttttaaaattatactttaagttctggggtacatgtgtggaatgtacaggtttgttacatatgtatacatgtgccatggcagtttgctgcacccatcaacctgtcatctacattaggtatttctcctaatgctgtccctcccctagccccccaccctctgacaggctctggtgtgtgatgttcccctccctgtgtccatgtgttctcattgttcaactcccacttatgagtgagaacatgcggtgtttggctttctgttcttgtgttagtttgctgagaatgatggcttccagcttcatccatgtccctgcaaaggacaggaactcaaccatttttagggctgcatagtattccatggtgcatacgtgccacattttctttatccagtctatcattgatgatgggcatttgggttggttctgagtctttgctatcgtgaacagtgctgcagtaaacatacatgtgcatgtgtctttatagtggaatgatttatagtcctttgggtatatatccagtaatgggatggctgggtcaaatgatatttctagttctagatccttgaggaatcgtcacactgtcttccacaatggtt

SEQ ID NO: 9408 - DNA, 927 bp, Homo sapiens
tatggatctgtttatccttttcttcctcatttttgtgctgttttgtaagatttctagcaatggcttccttttctgtcagtgtaagaaagtccagattctttaggaagtttgtgttggtgtggatgaataatatttatctctttcaacttttttgactggatttttcttgcaggaccctgaattttcttttgcttcttttcatcttcaccacccaaatgccaaaggattcctcttccttcttttttatttttccctgagaagctttggttttgaagactgttacttcaataatatacttttaagtccctgccctgtaaacctttctttgactggacactatagtagtattttcagatttagggtggactgacttggtctgcatttgccacaaagccttgcagcagaagcagggtgggcacaagtgtgtgagattgctccctgagatttaaaaatttacggttatttcaaatgtgggtattctctgtctttaagttaggctgagggtgtgtttttgtttagttttatctattttagttttagtttgacttccactgtcatcagtttccttggaagttcccagtgatgactaaattttcagaactgagctaatattttccagcttgaagggaaaaactagtaaaacatattttaaggtgttacatgatcaactctgaaaattacaactccattcataatggcagtcctattcagtactgttacagcacttcgcagttttgccaacactttcatatgctttttctaatataatcccctcaatgaagaaattgtgacatagattaaattcctgatgtcatgcagcagttaagtgataggaccaacttaacacaggctttctcatttacagtctgtgccttttctcctgtacctcattatttaaccttgttgattcacactaagtgtccaaac

SEQ ID NO: 9409 - DNA, 11343 bp, Homo sapiens
gccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggtgagcccgacgcggccggcggcccggggggccgggcctggctccaacaaagcgcccggcgccggcgcgcgaagccggcctcggggggacgagcgccctgcgcgctgccgctgccgctgccccaccggcctctgccctccccggccggaggcggctctcgaaccctcgcggcaggcgccgcaggtgcggcctctgggggggaggaggagctgggagccccgggtccgccgtacgcgccagttccctggttccctggctccctggccccgagtgtcgtgccggacgccggcccaggctttttacacttttttgcctgtgagttcttaacggcgttttggcgagggacgcatcgtctccattatattaatgagaaacagattatgcaacctagatgatgcggggctttaaaccggggcctctggttctgaagccctgtgcttgccacgacacccacaatgccgcccttgggtcctgcccagtggactgtatgtgccacaataactagaagagagggttttaaatgttctcaccaccaagagacaatacgtttgaggtcgaggacatgttaaacactctgacttgatcactatgcaatgtatatgtccatccatgctgcacaccgcaccccatcagtaggaataattactgtgtgtcgattatgaataaaaaaatgttttaaaggagcggtaggtttgcctctaaacaccatcagtcagtttcacggtgttggtaagatcagctcaggactgagacctaagggaaattgcccctgtggctcttctttaagagggggacacagtaaatacaccatgacaatagtctcaacaaccctccacgttatgcaaaacagggcagtcattttcaaccttgggacacatctgtgacgagcttattaaaaatccagatgtccagccccaccccggacctgttaagtcacaatctctcagtcattacaatggcaagtttccttccaccactctaggccagcagtgacataattcaaaagcgcaagtcattgaaagcagttctgcgaatatgtagcttttgatgatcaggagtaaatttagagtacccagaatattgcatgttctgtctgcccatagtcaggcttctgataagaatttcacagcagaaaactctgaggttgtagtctctagtaggacagatgtgtcgccaatgaagagtgatctgctcttaccaccatctaaaccgggatgcaacaacgttctcaattgaagatcagggagccagtcaggaaatgtacctgaggtatgctgaggaagaccgtgcaggtggggccgaattgttggactgaaaagctctgggtttctttcagcactcaagtgtaactctgggaatggctttcaacctgttgttttgttttcatactaaattttaactaaatcctttttttccctattgtttttgtgtttttttgtttgtttttgagacagagtctcactccatcacccaggctggagcgcagtggcgccatctcagctcactgtaacctctgcctccggggttcaagcagttctcctgcctcagcctccctagtagctgggattacaggcacctgccaccacaccctgctaatttttttttgtatttttagtaaagacaggttgcaccatgatggccagcttggtctcgaactcctgaccctcaggtgatccacccacctcagcctcttaaagtgctgggattccaggtgtgagccaccgcgaccgacctaaatcctttatttaatcataacttaggtggatgaactatttcttaatagtttctgttgttcctttctgtggagttgttgttaggagctctagctctttaaagaccctggtaaacatctgttgaacataaagataccatttgcctttcaggactggttagtatacagtaggtttgtttctaattatgttgggttttttttgttttgtttgagacagagtctcactctgtcgcccaggctggagtgcagtggcgccatcttggatcactgcaacctctgcctcccaggttcaagcgagtctcctgcctcagcctccctagtagctgggattacaggtgcataccaccacgcccagctaatttttgtatttttagtagaggtggggtttcaccatgttggccaggctggtctcgaactcctgacctcaagtgatccacccgcctcagcctcctaaagggctgggattacaggtgtgagccactgtgcccagccagggcaaacttttttttagcaggaattatacctcaccagatccatcatttttttcttgacaagcagactgactttcctgtcttgtcctggctttctaaccgcagtgccccgtggcccctgagcagctcctgtcttggtgtcttcctttaatgaaggttgtctgtgtgatgcaatagccatctatatgatggtgcccagtatggagatctgtaccctgtctggttactacatagaaggcttttcagggtcttgctctgttaacccaggttgctgtcaggctcttgagctcaagtgatcctcctgctttagcctccccagtagctgagactataggctcctgccaccatgccctgcctcaaacattgttctttttgtttgtttgtttgagacagtctcactctgtcgcccagactggagtgcagtggcatgatctcggctcactgcaacttccgcttctcgggttcaagcagttctcttgcctcagcctcccgagtagttgggactacaggcatgctccaccacgcccgactaatttttgttttattagtagaaacagggtttcgccatgttggtcgggctggtcttgaactcctgacctcaagtgatccgcccgcttcagcctcccaaagtactgggattacaagagtgagccactgcgccaggcctcaaacatcaatgttgatacctgttttcaaagtactggaagaaggtaggggtaaggacaaggaaccgggaggaaggctggctgggaagctatcttaggttttaagagctgtgttgaccagagactccatccactttctgccctgagtatcttattggcaggttttcttatagtcagtggaaattttcggtcttagttacagctgcttgcataatttctttcattgtttatatattttctagattatattttcttcccctccccactagttgctgttggttcttattttattctaatctttcttcccaaaacaccccacccccaaccaaatcttcccttcttaacataaatgatgagcaacgaggatgggtgagaatgaggaattggattgcaaactgtagagtatgtgccgccttctggtttgatgtgggtgcctaaggtatatggccatattccatatcctgtaaggaaatccagaaatctagcccagccttgtgtatggtgggattcatggagaaatgaaagccatgaggattcaggggcaggaagagcagaagtaaatgtacatttttttattcctagagattcttttgttccttgtgtgtgaaagcagtggaggggacaggcaggcacttaaagaacctcttatcaagcaacatttatattgtaaaacatggcttagaggattttgtgttatttttagtccagaggtttgtttttaatgatttgccagaaattttttaaggaaaggaaaggttccaagttactctatagactatactgtacaaagatttctaattttaaatttagaataagatgacaaagcaaaccgtttccttcttggatgctttctcggaaggcagtcaggtggtgctagagtagctagacagacagtttttcctagtttttgctacagttcttacaatcgtttcttttcaccctctactcttcaactgtgtcttacttttcctcttgtatattttctttctgtcttgttactggattgtttcctctcataggttctcttttcagttatgcgcacaaaagatacagtacaaaaagtccagtgcattttattcttgaaagtatatagaacttcagaatgaaaacaccactttctcactgcacttccattttatcgtgccattgccatttctcatctgagccatcctacccttgagcttattctctgaggacagaaatgggaagaaggccccagaagcagtgggtgggggtgggaggaggctgctgtgctggtgagtggtggggtgttggctctcagaaaacaggagcatggacagtgtcagcttgttgccatgacagtgaggttattaacatccacttagactgtcttcagtggtctcttacccaggcatgatagttttggcttagatggctacctgaagagattcagtataatgctaccagtttttattgaacatttattctgttcaaaacattcccaaaggcaacagaagatacaaataaatctctgcccatgaaaaggtgtggggggcattagaaggcgttctcttcggtgtaatgaagtaatgagagaagaaaaagtagtttgaagctatggagtaagggactttgagtatcccaggctcaaaaagttgggacttgaacagtacgggggtgctgctgaaaacgtttgagggaggtaatgacatgatcgaagctatacttgagaaaggtgaatctgataaagtatgagtgaaaaagagactgaaggtctagaaattagattgaggctaatgacaaaatccacataaataggaggacttgaacgaaggggcacttagaagaggacaggagatagtaaaaggcattcaatgatgagagcacacactacaggggagcatgagggaggttggaaaagataatgaaaggattaccgagcttcactgacgatgtgtttgaaatgagcaggaatcttgtagtgatcctaatccgtggttttctggagcatttcacagcctaggaacatacaaggggggcatctccctggaatgtaaattgactaagaggaattcaataatggtcaaatgaatgcagaattttagagtcttgcttagtattctcaccacatttcgtttagtctactcatactctttttctcttactgctgacactagatggaaaaactcttaattaaaagtatttcacaaaatgtgctcgttttcagtcattccgtttccactccagcctgttgtgttgtttttttgaaataataatttaaagtaattttccttttgcaggatggcatagtcaatccaacaataagaaaagatttgaaaactggaccgaaattctactgctgtccaattgaaggctgccccagaggccctgagagaccgttttctcagttttctctcgtaaaacaggtactctctactctgaggatgagatacagatgctaaaaacctattgtgcattctgattacttagcagacataactacagaattgagtagacagctgcttgtgaggggagatgcctgcgtgtctcccagttggtataaacctgagtatgctgttacacaagtggagggaaaagcggcacggtctggagggaatatgtctagaagtgagttaaaatacagagagagagagtaaaccagttcagcaaagaatgagaaaatgtttgctcgcagatctcctgtgtgagtctgcatacctccaagggcccagcgcaaaggcacaaaggaactgttctcccaggggaataagaacctgcagaatccaggaaaagaagagttttggaagccgcaatcttaagaggagggagggccccagtgactgggacaagaggtgattcagaactggaagagattggcatctgaaatgttcccctgagggtctgctggagggcgtcctgagaagagcattgtaaagacatttttttcctgcctgcagcacttacagatcagagtgtaaatgctggagaccatagatgtttccaaaacaatctcctcacttttcacaaagcaaaagcaacaagaagaggcatatatataattaactgcgatgttcctgcttttacattcttttgacttggactgctgtattttatgttatttatattaatagtgtaaaatcattattaatttgggtgtatgatggtttctgaaatgttttgaccagttgctgtttttcaccttagtcccttctgcgttcctcctagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacaggtgaagggaaagaaatgatggcacagaagtcagtagctatgggaagcatttcagatgaaacatcctggagagccagtggtgtggggaggaaaaaggaatcttagaaaatgtgtgacgtggaagaaggaagcttttgaaaatggaagcaggtcttgcaaatgacacatgtctgggcctgaaatcttgacccaattgttccccctatttttttctgccagccctctttgagagtcccttgttatttccatttgaaaatctcagcttccagaattttctatcagagggaaccaaactgccaacaaataagttttatcatgaaactgtacttcatttaaaggtcaaattttcatttagtgtgatagcttcctgccttagaaatgataaaacttgcattatgtaagtcttttagcttcttttggcttaaagatctgagttgagttctagtacttagagcttaacaaaaggtatgtttcctccttctctgtttgcatgtttctcaaagttcacctgctataataggaccaactcccagagttgcgaaagaatggatttatcttgtctgggttgaacatgacctctgctatagatgggggaaatggcatttgtaagtgaggatagagtgtcatggtcgaagaaagttgtattttaaggttttctttttgctctgtcattgttttcagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaaagtcgccagcaacaagcacgtagtgtagtgttcctgctaaatgagcataggttatccaaaccttgggaacagggagttatggaaacgtgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacgacatgctcctttctgtggcacatgcctgtattactgaaagctaaatcctcaaaacctagtaaggggaccaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttatttaataata

SEQ ID NO: 9410 - DNA, 970 bp, Homo sapiens
ttactgattctggagatggaggaagggtccgcaagccaaggaatgtaggcaacctctagaagctgggaaaggcaagtgaacagattctcccctggagccttgggaaggaatacagccctgctgacaccttgatcttagcccagcagtctcatttcttttgacctccagagctggaagataataaatgtgtgttaaggcagtaagtttgtggtaatttattaatagcaagagaaaacgaatatagctgctagtatgtaaaaggtggaaattttcacataaaactctagccataccaaagatgagtagcagctgcccccttttaataaaggatgtgtttccaatttcactgcagtcctcacccctcccttttgtctaccccagcctcctatgtccatttacatgaactacccagtctaagtattaagttttgtaatcgtatactgaactgcagtgtctcccaaacagtaatcctaatttcagcagctaaaatagaagcaagcaaatccagccttcttaaaatgattaaccctatcaataataacaatcttttcatttgtatagtgtggtctaggtcaagttacttaatttatataagcctaaatgtccttctctgcacaaggtggggcaagttacagtacatacccgctacagtcgttttgaagacaaaatgagacacagcatgaaaagtgcatccaccagacccacctggtacccagtaaggcctaggtaataaacaacggcggaaatcagtgtacttctgcctcacctgccactagacatttgggttgtttctaatctttgggaagtaaacgcattgctcaacgtattgctttttcttttatgtgactactgcctgaagtcactttcctaggaagaatggatcgattagagaggcggggcaataccttttacctgctggcaggtgaaatttcgcctcctggcggcgtcacctaaagtcctctccctccaa

SEQ ID NO: 9411 - DNA, 11343 bp, Homo sapiens; identical to SEQ ID NO: 9409

SEQ ID NO: 9412 - DNA, 970 bp, Homo sapiens; identical to SEQ ID NO: 9410

SEQ ID NO: 9413 - DNA, 13024 bp, Homo sapiens
aacaggctcctgcaggagatgggtcacagacccgagggaagatgtctgaaggtggaaggaaatccagcctgctccagaaaagcaaaggtgcgaaacagccatggtcctcgggcagtgatgagcgcggcagtaaattttgtctccatgggtgctaagttaaagttccttctttcctttctgggaagggtcagaagcagtgagcagagagagttggagcataaggacagactggggggatgtggggaggtgagtggggatgcggagcaaaggggagatcatttcttccctgtgtggccccagagaaaagccacattgccatcatggtactgctttgtgacatcagtttcttgtctatgtgactgttttcccactggtgctctgagagcaagactcttagagaggctgtgaggactcatcctgaggtcgggagttcgagaccaacctggccaacatagtgaaaccccatttctactaaaaatacaaaaattagctggccatgatggcacacgcctataatcccagctacttggggtgagggtgcagggctgaggcaggcgaatcgcttgaacctgggaggcggaggttgcagtgagccgagattgctccattgcatgccagcctgggcaaccgagtgagacaccgtctcaacaacatcaacaagaagactcagctctgctgtttgtaacattaaaaacaaccccagaccagacatagaggaacaggtatagctgtgtgccaataaaactatttacaagcaaaggaagcgggctggatttggcctatgagctacaatttgccactcctggtgtagatgtttgtgagaattcgcgctatgcccttcccaggcgtggttgagaagcaggcacactagagccagcctgctagtctttccccatctaattgggttgaaggccatgcatgaagctgggaatgctggtgtggccaggggatcagactgggcctgccacaccttaaaaccagttcttactcaagggcgattctgacccccagggaacgcttaggcagtgtctggagatgtgtttggttgtcatatctgggggaaggggttctactggcgtctggtgggtggaggccagggaggccacttaacatcctgaatgcacaggacacccccaccaccgcaaggaaggatccagccccatgtgctcgcaatgccatggctaagaaaccttaatttaaaccacaccataatgatttcaaaggactgcttgtttgagttccattgtatggctttgtagaaaattaatttttttagtgcaaatgctatacatgctgatgataaaatattccagggcaaaagcaataacaataaaaagttaccacctctagctgggtgtggtggctcacgcctgtaatcccggcactttggaaggatgaagccggtagatcccttgagcccaggagttccagacctacctggcaacatggtgaaaccctgtctctactaaaaataaaaaaataaaaaattatctgggcatggtgacacttgcctgtattctcagttacccaggaggctgaagtgggaggattgcttgagcctgggaggcagaggttgcagtaagcctagattgtgccactgcactccagcctgggtgacagagcaagaccctgtctcaaaaaaaaaaaaaaagaaaatttccacctcctcaccccaggctcccagtctgtgccctgagggcatgtgctctcaatagatttttgctgatctttccagattttttttaagaatttcaacacaaatcgttgttatattgtaccctacacattgcagtgaccttcctcttttcatttccaggtcattcatttcctcagctgcatagttgttcatgaaatagtctcatgcttagttcctaacacaacataccgtacgtgccatctgttggcatctgcagcactcctgggctcttgtgtagtggtagcatgctgtatgctagtgcccatcttagacagtgtaaggcttaattttacagtttagaatatacgttaaaagatgaagggaactcccagggaggatgaacagtccagaagctgcagaaaaaagatggaaagattacttggctgagtgcggtggctcatgcctgtaatcccaacactttgggaggccgaggtggatagatcacctgaagccaggagtttgagaccagcctggccaacatggtgaaacctcatctctactaaaatacagaaattagctgagcatggtggcgagtgcctgtaatcccagctacttgggaggctgaggcaggagaatcacttgaacccgggaggtggaggttgcagtgagccgagattgcaccattgtcacctgggtgacaagagtgaaactccgtctcaaaaacaaaaaaggtggaaagagagtagagggtagaatgggaatatggcatcgtatcccacctgtagcatcttgtgaactagcagaaaggcctatttgcgtctctttggttatacagaatgtctctgtcttctagtggtactttaaaaatagagtcaaggtgatggctgggaatttccacaggttttttttttttttttttttttagcctttccaccttggacgaaattgggcttttagaagcaagtggtattgttcaaaaacacggcctgcgtttcctggcttgaatggagagtgtctcttgactgtgctgactttcggggattcttttcttaacagcagatagcagtggggtcggaaagggtgacctgcagtccacgttgctggaagggcatggcacagctccacctgacctggatctctctgctattaatggtaaatcatttgtttcaccccttctgtcactcactgggggttgcagtaggtctcagtgggcttccaaagtacaattggcctacagtggggtcacatccaacaaacccattgtaagttgaaaatattgtacatcaaaaatatacttaataccttggtaaagggtattaaacttgccttttgccccttgcaaagttgaacaactttaactggactgttataagtccatatactcctcaatttatgatggggttacatcccaataaacccatcattagaaaaaaaatggcaaccagggaccagtctatatacgctacttgccattaaaaatgctgtgctttatcttagacaaaagcatcgtcaaaaagacgccacagttagcaaaaacaatatcaaagaaacctgagtcaacatcattttctgcccctcggaaaaagagcccggtaagtgtctgaaagaagagggcagccacagatgggttgcatagatctgatttagagtccactctgaaccagatgctgagtgcccacggatccaagaacataaaagacacccatgccctttaggacaaaaatcaagactacagatgttcttagatcatttgtagagtttacatttccccaagtacacattcagtagtggataccaatatggagccatgtaaaaaatgagacaggggacttctctgtgcccatgctgtgctgggaaaggcacaatgccaggccctgtcccttggtgggaggacggctaggctgtggtctcactggggtgaggacaagactggtggttgggggaccagcaggtggggagacggcattctggtcctggtgcagcaccaaattggtgggtattctcagcttgtccttgactacccagctgctgctgtctctccacctgccaggtgccaggggaaggaaggttgtggacctccctctttcatctcagcgccgcagaaaaccaaataaaagaaaatagaagcaatagacccactacagtagagaactaccgaatatcaaactgaatacagaaaatccacacaagccagagttctccccctgctgggaaaagagctggatttataccacttcatcaggaattgagagggtctttttcttttcttaaggatttatctgaagcaatggaaatgatggagtctcagacactactgctgacgctactatccgtaaaggtgaaaacagtttcttgttcacgtatgccatggatggaagggtggcctccattcacggggagggagtccccacctgcttgagcttttctttcacatttaacagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccaggtcagttgtaagtgacactctgtgaccagtgagtgttccctgtgaatctgtcccatctccactgtttcggtagcattcgtgctagggtatcattgctcactggcttctaactgtgttgggcttttaatgccacacttgctctggtcctggtgttggtctatgatgacacttttagagaatgaggttacaaagtaaagtgtgaatgaataagggaggtgtgcaccttctatgcacttgtgcagagacttcctgagcgcctgatgatcgtgagcagcaacaggatgacgtgctctgggactcccctgcagggtcagggtactggtgagaggcacatcactcctaatgctgtgtggtcagcagtgtccatgtgggagaaggacaggaacaaacccctggaacccagaaagggctgattggcaggggcggaccccccacccagtgggtgagtttcctgtggttgctgggacagagtcccacaacctgggtgggcaaaacaactggaattcattctcttacggttcaggaagctgaaagtccgagattgaggtgttggtggttggccctgtctgagggctgcgagggagaatctctcctggccctgtctttggcctgtgaatggttgtcttctctgtgttcacatgtcctccctgctgtgtgtgtctgtgtccccctttccccacaagacaccagtcgtgttggattagcatcccccctacaacccccctatcacctcatgttaacttgatgaccctgataaagtccctcttttcaaataagggcacattccaaggtactgggagttggatcatcaggtatgaatttggggggatacagctcaacccctaacatccaaaattttcatgtgagcacccgtgcagctagaccctgggcttgagtacaaggtctctgactttagggagctcaaaatggaagaaaaagagacaaacccagttgaccctcaaacaacacgaatttgaagtgtgaggttccacttacatgcagatttttttcaataagtatattggaaaaagttttagagatttgtgacaatttgaagaaactcatagatgaaccttatagcctagaaatactgaaaaaattaagaaaaagttaggcatgtcatgagtgcatacatacttgtcccagcatgggcaacatagtgacacccaatctctacaaaaaaattttttttttttttgagatgggcgtcttgctctgtcacccaggctgtagtgcagtggtgctgtctcagctcactgcaacgtccgcctcccaggttcaggcaactctcatacctgagcttcctgagtagctgggactacaggcatgcaccaccacgcccagctaaattttgtatttttagtacagacagggttttgccatgttggccaggctggtctcgaactctggacctcaagtgatccgccctccttagcctctgaaagtgctgggattataggtgtgagccactgcatccggccaatttctataaaaattaaaaattagccaagtgtggtggcatatgcctatagtcccagctacttgggaagctgaggcaagaggtttgcttgaccctgggaggtggaggctgcagtgaactgtgatcactccacagcactccaccttgggcaacacagtaagatctgtctataaaaaatatgtatgtgcagtggctcacgcctgtgatcccagcactttgggaggctgaggtgggcggattacttgaggtcaggagtttgagaccagcctggccaacatggtgaaaccccgtctctactaaaaatacaaaaaattagctgggcatggtgatgcgtgcctgtaacccagctacttgggagactgaggcgcaagaattgctggaacccgggaggcagaggttgcagtgagccgagactgcgccgctgcactccagcctgggagacagagcaagattccatctaaaaaatatatatgtgtatgtgtgtgtgtgtgtgtctgtatgtgtgtctgtgtgtgtgtgtatgtgtgtgtgtatatagatgctaatctatttacatgtttattgaatgtttactatcagtaaggtttcagtcagcagtagctatcagtaaatttgggggaagtcaaaagttagatacagatttttgactgcacaggggttgatgccccaaactcccgtgttgctcaagggtcaatcgtatatcatttcaaacccccatgaagacccagacagcatgtttggggtgggagtgggccatgccggggatggccttgtggaaggcaggcgtttaggcgcagtactctaaagcaggtgggctcagctgagggcccaagcctagaaccgctggcagacacatgttctcagtaaggggcctgggccgccttgccatccacttggctctcttgggaagagctcaccacaccctcggaaacttcctgagctctgattccctggggggtggtgaagaacagcgctgtatcttaaccctgcacaagccgttaagcttctgttaagtttccagagaggggactccagggtctcccctgattatcccttctgcttacagatcgagatgctcagccccttcgaggcagtggccacacgcttcaaggagcaatacaggacattcgccacggccctggacactaccaggcacgagctgcccgtgaggtccatccacctggagggagatgggcagcagctcttaggtaggaaacggggcgtcccagtgcgtgtgcagcaggcggggcgaggagcgtgtgtgggtgcttcctgtgggcctgatgtcatcaccgcaagtgccctcttccccaactaaggcagaggatggggagggctggccaggctgtggttcctccaagggtctcgccctgagtaagtaaccacactgggatttgaaccttgggcagtgggattcacagtgatctgtcctgccgaaaggcattttgcggggacgacctgtagtctcctgagtcctgctcccaacaaatatgccgtagtggttggggggtgacaagaccaccagccccaccccggctttccccctcagcagagcagtgaggtccctttcaggcatagggttcccacctaatccctaacttgaagactttggcaagtgtgaaaaactgccgcgttgcaccttaaattctcttcagaacaggtatcttcccacagagcaagtttttggctaccctggagtttggttctttttttttttttttttttttttgagacagcatcttgctgtgtcgcccaggctggagtgcagtggcacaatctcagctcactgcaacctctgcttcctgggtttaagtgatcctcccacctcagcctcctgagtagctaggagtacacgtgggcaccaccacacctggcttatatatatatatatatatatatatatatatatatatatatatatatattttttttttttttttttttttttttttttctgtagagacggggtttcgctatgttgccaaggctggacttgaactcttgagttcaagcagtcctcccaccttggcctcccaaagtgctgggattatagacatgagtcaccatgccctgccattgttcttttttttctgcggaggtggaatcttctagcgtagtcacccagcctggagtacagtagtgcaattatagctcactgcagccttcaacttctcaggctctactcagatcctcccacctcagcttcctgagtagtagcctccctagtgcttcaggcatccaccactgcacctggctaatttatttttgaaacggagtttcactcttgttgcccaggctggagtgcaatggtgcaatcctggctctctgcaacctccacctcctgggttcaagcgattctcctgcctcagcctcccgagtagctaggattacaggcatgcaccactatgcccggctaatgttgtatttttagtagagacagggtttctccatgttggtcaggctggtcttaaactcccgacctcaggtgatctgcccgccttgccctcccaaagtgctgggattacaggcatgagccactgctcctggcgcacctggctaattattatatttttttttgtagagacgaggtgtggctatgttgcccaggctgatctagaactgctgggctcaagtgatctcctaccttggcctcccaaagcactgggttcctgaataggtgtgagccccctgcccggccgggtttctgattttatgactgcggtcacctccacatctgtaactcttagaaaacactcagtctctgctcagttccttaggtagttcctgggaacggcctagggatcgtgttgagttttccggggctgccataccaagcggccacagaatgggtggtttgcaacaacagaaagatattccctcccagttctgggagtcttgatttcagccagaagtctgaaatcaaggcgttgatgggattggctccctccaggggctgtcaggtgagctcatcctgtgtctcccccacctgctggtggctgctggtggcccttggcgttccttggctcatggccgtgtccctccattctctgcccgtcctcacgtggcctcctccctggctgtctcgttattgaaatttcctgcatcaggctcagcacggtggctcatgtttgttatgccagcactttgggaggctgaggcgggtggatcacgaggtcagtagttcaataccatcctggccaagacggtgaaaccctgtctctactaaaaatacaaaaaaaatagccaggtgtggtggcaggtgccggtaatcccagctactcaggatcctgaggcaggagaatcgcttgaacccggaaagtggacgttgcagtgagccaatattgtgccactgcactccagcctgggtgacagagcaagactctgtctcaaaaaaaaaaaaaaaagaaaaaaagaaatttcccgcatccgatgaggacacaagtcactggattaggccccacccatcttaactcccccccatccacaaaaccctgtttctggttaaggtcatgttcactaggagtggaggattggagtgaaacgtacgtattggggagggcataattcggtccacagccggagggagaagaggctggctgatacggcacttaaaaggctcccaaaatgtgactctcatgtacgactggccttgatgtgatgtatgtcagggtagagaggcgtgttgtcctagtgcaggtgacacaggtcccgcagttgcaggcatccttctgctcagtggtgcaggcaacaaggactgtttttcagttgctcatggtctggcttggaggcctcaggcattctccctggcacagcacagcccttttcacatttgcattggtttctgttgaggacaccagagtgacatttcagttctggtccaatgccctcctggatagatggatgtgcctgtcccacaatctcagagcacgggatggataagggacgaatgtcttccttggcttctgcttcttccctgtgcgctctccacggttccagcgcgatagccgagcatcatgacagaagtctgtcggccgctccacttgtgtgtgccttgcgtggggcaccttgccatccatcgcccaccatccctcttcccctccagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggtacctcggaaaatgctttaagaaagaggtggcaccctgtttgctcagggctgttggtggctgcactgttggggtggtgccgagttcctctaggagttcagaggaggttcagtcccctgagcgagctgctcttttcccagacgctgcatgatacaagaatggccagcaggtgtcattgtcatctgtattgtggataacaaaatctccatccaaaagcacccgccttgccttccctttcttttttttttgagacaggttctcactctgtcgcccaggctggagtgcagtggcagatctcagctcactgcaacctcaaattgctgggctcaagtgatcccacctcagcctcttcagtagctgggactgcaggtgtgcgccaccatgcccagctaatttcccttttctagcctacttctcagtcatttttgagctaatggggactctaggtgaagtgaggatcaaatatgctataagacgtgtcctagattcacagagtataagactcaagcagagcagggggaagagagaacaaaagagctcagaaaaatccatggaagggccaggcgcagtggctcacgcctgtcatcccagcactttgggaggccgaggtgggagaatcactttaggccaagagttcaagaccagcctgggcaacatggtgagaccttgtttctatttatttatttatttattttgagacagagttgctcaggcttaagtgcaatgtcatgattttggctcactgcaacctccacctcctgggttcaagcaattctcctgcctcagcctccgaactaactgggattacaggtgcacaccaccacgcccggctaattttgtatttttagtagagacagtgtttcaccttgttggtcaggctggtcttgaactcctgacctcaagtgatctgcccacctcagccccccaaagtgctgggattacaagcgtgagccaccatgccgggcctctctatttaaaaaacacaaaaattagccaggcacactggtgcatgcctgtggtctcagctactcaggaagcagaggtgggagaatcatctgagcctggggaggtcaaggctgtaatgagctgtggtcgtgccactgcattacaacctgagcagtagagtgagaccctgtctcaggaaaaaaaaaaaaaaaaaaaaaatctatggaagttctcaagcagctggaagagaaagggtgtcacctatcattcacatcctcagagtaacccagcagcacaggcgccctcacatcagccctgttggtgttttcaatgccttccagggtaaggtcccaggaggatgttttttgaacttctgattgatagaaatggcccagatcttaaaggactgtgcagtggcttgcacagagcacatatccttgtgcgtccagacccccaaaacccatcaagatctccccccgcttttttttttaacctcccccaggagatttctaaccacgcgcttttctccacctcttccagtagagtatcttttctcttttttacaatgctaaatctttttcctgagttgcttaaaatattggaaaaggacttatgcaaaacagccagccacccactgtggcatttctttctcctgtgggtggccatggatcaattcaggagacatcaaagggttataaagccacagtcccactcccaggataactcattcatccatgaacggcagaatgttcatgaacccagttacctcttaaaggccccacctctcgctgctgccacattggggattattattattattgagacaggatttcatttcattgcttaggctggagtgcagtggcgcgatctcggttcactgcaacctctgcctccgaggctcaagcgatcatcccaccccagtctcccaagtagctgggactacaggcgtgcaccactgcacccagctaatttttttttttttgagacggagtctcactttgtcgcccaggttggagtgccagtggcgcgatcctcggctcactatagaccctgtctcctgggttcaagcgattctcctgcctcagcctccccagtagctgggattacaggtgcgttccaccacgcccggctaatttttgtatttttaatagagatgggctttcaccatgttggccaagctggtcttgaactcctgacctcaggcgatctgcccgcctcagcctcccaaagtgctggaattacaggtgtgagccacagcgcccagtatttttaaaaaaatttttgtatagacgtggttttgccatgttgcccaggctggtctcgaactcctggcctcaagccatctgtctgcctcggcctcccaaagttctgggattacagcacttcaatcccactttacctggccaggggattaatttttaatgggagttttggaggggacagatactcccaccacagcagcagcacagcactgagctccatgaacatttcttggatgaatctttcctttcatgtctggtgctgttcttggggggtttccctgattgagtcttttcagacggatcttatttgctggccctttcccactgagcacgtagggcatgtgaaaatccgcctccccgtgtggcagccctccgttcaccacacacatgcgcttcacctcagagggtgaaagccgttattctttctcccatcctcaacaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattgaa

SEQ ID NO: 9414 - DNA, 183 bp, Homo sapiens
ttgcttttggttattagaaggccagtgctccatgtgtttctttaaaaaaatattttttgacaacatatgtgtaaaaactttgtttctcctgatgaccaaagttatatgttctctctggaaaactagcaaatacttaaatgtgtctagaaaaaaatcagtcacctgtaatctaccatgtcaata

SEQ ID NO: 9415 - DNA, 4540 bp, Homo sapiens
caatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 9416 - DNA, 139 bp, Homo sapiens
tgcctgtaagtcccagctacttgggaggctgaggcaggagaatcgcttgaacctgggagacagaggttgcagtgagccgagatcatgccactgcactccagcctgggcaacagagcaagactccgtctcaaaaataaaa

SEQ ID NO: 9417 - DNA, 2632 bp, Homo sapiens
ttttcatgcttccatagaatcatccctgacctcaggaaaaaatacaaaaatggaacaaacaaaacagaatagtaaaacctgaagtaagaaaaaaagaaatgaatttgacattgtacagatcaggagaaagaaagttcattaacagtttcaagatccctgcgttttcacccagcaggaaacaaattaccatgagttaaggtggggaaattactggcaattcattgccttcttttaaagactttaaaaaaaaatgagtaaataattttagactattaccccctttccatgagagatacacagctagttaaactgccatgcatattaattttttgttttcattttattccacctaccaactacacagtgtctgctttccaaaattagtttgaaagccaatgacctgtgtttgaactgggtgaaatagcatagcagttcacacctggaataaaagaatgattgtgtgtgagtctgttaatggctgtgtagagctatatctctatatggagctatataaaaatatattttatacatgccagattcatttagacttgaattgaccctgtggtaaagcagcaggaataaaatatttttttgataaagcactcactcaaatagagaaatgagctcttgcagttaccatttaatctgtgacttctttttgagatgcagaaaaactccattataaagtgctcagttcatccagggacacagacacactgtgggttataacacaccctcatctgcatggtgaggtacatgagtcagctgctcttctctcaggagggtggctttaaagctccacagtcatgcatgctgccaattccagattgtccaaacctgtaggttagcaaggacacaggtgagccataggtatgacatgttcataaaaagaaaaatatattttaatacaaaacatgtcaggggagtggagagtgtcaaattgaggacaggagagacctagattcaatgccatagttcttggctaatctctgagaagcttgttagtcaccctctttctccttcccttactctcctgtatcttcccttacatactgcatagtcccttgtaatttacaagacataaaatacttcctttgttcatctgtatactgaatgtaagaatgaacaaaaggtcatcataaggacagcctgtgagtttatgcactgcatactgcaaatgacccactccagcaatgggaagacacccctaacattgcttctctccttataacgaaaatatattcatcatcagctttaaaatggatcttctcaactctgtgcagtctccgtggtaacgtcccataagcccagggttttaagacctttctcctgtgctctaagcctacatatctaactgcctaatggcctttccacttgaatgacacatcattcagtttcagtgtcctaaactgaagtttcaactccaagtctgtttttttctcttgtagtcttcatgtcagtcaatcagtcttttatcctaaccagaaatatgtgagttctcatggattcctccctctcactcacttttcagttctataatcacccagttcctacattgtttgcatcttaaatatctcttctagtcctcccttctcctttatacccactgccactgccacaatgttagctccttcagatctcatattttctcacttttattgctatagacataccccccgcagttatcctacctctaggcaaatcccttccaaaatgcagctgccagtgtgatctttgtaaaatgcttttatgataaagttcaaactcattagcaaagcacacaaagacctttgtgatgtggtattgctgaattaaactactggcagccctagaaaggtaaagtgtatttgatgcttctgtgctgttcccttagcccagaaagcccttccagtttctgtttagtaaagtcctattcatctttcactactcaatgagtcataagtaatcccattaggaaagcctgtgtgatctacctcctccctaatttgccaccttgagtttgcttcaccccttcataatactcagtcaatcataaatgtcttataatccatcatagcacctcacacaatgaactccaatgtctggtttgttgggatgtccgccttactacattgtaagcttcttaagggtagaaaccagttctgataggcttagggcagtgaccaccaacagaaaaagtacttggtaaatgtctaacacaatctgttttactttttccagagcacgaggcatgcatgaaagagattaatttactccacatgggaagttactacccaggcttaccaaaaggtcaggtttatataaagtggcgttcctttttttcccccttagtaagacattaaaaaaagaaaccacaattgaaaagcagagctatctgtgatacggaatatgaacacagaatcagattctcatagcagctaagctgttccccaggcagtggttctcaaggtgtgcttccaagaacagcagcagcagcggcatcacacatgcaaattactggactctgccccagatccacagaattggagactggggatggggcttagcattctgttttaacaagtcctccagatgattctgttgtgtatctagctgagaatcactgccctggagaatggaaaaaaaaaaaaaa

SEQ ID NO: 9418 - DNA, 2616 bp, Homo sapiens
ttttcatgcttccatagaatcatccctgacctcaggaaaaaatacaaaaatggaacaaacaaaacagaatagtaaaaccctgaagtagaaaaaaagaaatgaatttgacattgtacagatcaggagaaagaaagttcattaacagtttcaagatccctgcgttttcacccagcaggaaacaaattaccatgagttaaggtggggaaattactggcaattcattgccttcttttaaagactttaaaaaaaaatgagtaaataattttagactattaccccctttccatgagagatacacagctagttaaactgccatgcatattaattttttgttttcattttattccacctaccaactacacagtgtctgctttccaaaattagtttgaaagccaatgacctgtgtttgaactgggtgaaatagcatagcagttcacacctggaataaaagaatgattgtgtgtgagtctgttaatggctgtgtagagctatatctctatatggagctatataaaaatatattttatacatgccagattcatttagacttgaattgaccctgtggtaaagcagcaggaataaaatatttttttgataaagcactcactcaaatagagaaatgagctcttgcagttaccatttaatctgtgacttctttttgagatgcagaaaaactccattataaagtgctcagttcatccaggacacagacacactgtgggttataacacaccctcatctgcatggtgaggtacatgagtcagctgctcttctctcaggagggtggctttaaagctccacagtcatgcatgctgccaattccagattgtccaaacctgtaggttagcaaggacacaggtgagccataggtatgacatgttcataaaaagaaaaatatattttaatacaaaacatgtcaggggagtggagagtgtcaaattgaggacaggagagacctagattcaatgccatagttcttggctaatctctgagaagcttgttagtcaccctctttctccttcccttactctcctgtatcttcccttacatactgcatagtcccttgtaatttacaagacataaaatacttcctttgttcatctgtatactgaatgtaagaatgaacaaaaggtcatcataaggacagcctgtgagtttatgcactgcatactgcaaatgacccactccagcaatgggaagacacccctaacattgcttctctccttataacgaaaatattattcatcatcagctttaaaatggatcttctcactctgtgcagtctccgtggtaacgtcccataagcccagggttttaagacctttctcctgtgctctaagcctacatatctaactgcctaatggcctttccacttgaatgacacatcattcagtttcagtgtcctaaactgaagtttcaactccaagtctgtttttttctcttgtagtcttcatgtcagtcaatcagtcttttatcctaaccagaaatatgtgagttctcatggattcctccctctcactcacttttcagttctataatcacccagttcctacattgtttgcatcttaaatatctcttctagtcctcccttctcctttatacccactgccactgccacaatgttagctccttcagatctcatattttctcacttttattgctatagacataccccccgcagttatcctacctctaggcaaatcccttccaaaatgcagctgccagtgtgatctttgtaaaatgcttttatgataaagttcaaactcattagcaaagcacacaaagacctttgtgatgtggtattgctgaattaaactactggcagccctagaaaggtaaagtgtatttgatgcttctgtgctgttcccttagcccagaaagcccttccagtttctgtttagtaaagtcctattcatctttcactactcaatgagtcataagtaatcccattaggaaagcctgtgtgatctacctcctccctaatttgccagcttgagtttgcttcaccccttcataatactcagtcaatcataatgtcttataatccatcatagcacctcacacaatgaactccaatgtctggtttgttgggatgtccgccttactacattgtaagcttcttaagggtagaaaccagttctgataggcttagggcagtgaccaccaacagaaaaagtacttggtaaatgtctaacacaatctgttgtactttttccagagcacgaggcatgcatgaaagagattaatttactccacatgggaagttactacccaggcttaccaaaaggtcaggtttatataaagtggcgttcctttttttcccccttagtaagacattaaaaaaagaaaccacaattgaaaagccaagagctatctgtgatacggaatatgaacacagaatcagattctcatagcagctaagctgttccccaggcagtggttctcaaggtgtgcttccaagaacagcagcagcagcggcatcacacatgcaaattactggactctgccccagatccacagaattggagactggggatggggcttagcattctgttttaacaagtcctccagatgattctgttgtgtatctagcttgagaatcactgccctggagaa

SEQ ID NO: 9419 - DNA, 896 bp, Homo sapiens
ttttcatgcttccatagaatcatccctgacctcaggaaaaaatacaaaaatggaacaaacaaaacagaatagtaaaacctgaagtaagaaaaaaagaaatgaatttgacattgtacagatcaggagaaagaaagttcattaacagtttcaagatccctgcgttttcacccagcaggaaacaaattaccatgagttaaggtggggaaattactggcaattcattgccttcttttaaagactttaaaaaaaaatgagtaaataattttagactattaccccctttccatgagagatacacagctagttaaactgccatgcatattaattttttgttttcattttattccacctaccaactacacagtgtctgctttccaaaattagtttgaaagccaatgacctgtgtttgaactgggtgaaatagcatagcagttcacacctggaataaaagaatgattgtgtgtgagtctgttaatggctgtgtagagctatatctctatatggagctatataaaaatatattttatacatgccagattcatttagacttgaattgaccctgtggtaaagcagcaggaataaaatatttttttgataaagcactcactcaaatagagaaatgagctcttgcagttaccatttaatctgtgacttctttttgagatgcagaaaaactccattataaagtgctcagttcatccagggacacagacacactgtgggttataacacaccctcatctgcatggtgaggtacatgagtcagctgctcttctctcaggagggtggctttaaagctccacagtcatgcatgctgccaattccagattgtccaaacctgtaggttagcaaggacacaggtgagccataggtatgacatgttcataaaaagaaaaa

SEQ ID NO: 9420 - DNA, 2634 bp, Homo sapiens
ttttcatgcttccatagaatcatccctgacctcaggaaaaaatacaaaaatggaacaaacaaaacagaatagtaaaacctgaagtaagaaaaaaagaaatgaatttgacatgtacagatcaggagaaagaaagttcattaacagtttcaagatccctgcgttttcacccagcaggaaacaaattaccatgagttaaggtggggaaattactggcaattcattgccttcttttaaagactttaaaaaaaaatgagtaaataattttagactattaccccctttccatgagagatacacagctagttaaactgccatgcatattaattttttgttttcattttattccacctaccaactacacagtgtctgctttccaaaattagtttgaaagccaatgacctgtgtttgaactgggtgaaatagcatagcagttcacacctggaataaaagaatgattgtgtgtgagtctgttaatggctgtgtagagctatatctctatatggagctatataaaaatatattttatacatgccagattcatttagacttgaattgaccctgtggtaaagcagcaggaataaaatatttttttgataaagcactcactcaaatagagaaatgagctctgcagttaccatttaatctgtgacttctttttgagatgcagaaaaactccattataaagtgctcagttcatccagggacacagacacactgtgggttataacacaccctcatctgcatggtgaggtacatgagtcagctgctcttctctcaggagggtggctttaaagctccacagtcatgcatgctgccaattccagattgtccaaacctgtaggttagcaaggacacaggtgagccataggtatgacatgttcataaaaagaaaaatatattttaatacaaaacatgtcaggggagtggagagtgtcaaattgaggacaggagagacctagattcaatgccatagttcttggctaatctctgagaagcttgttagtcaccctctttctccttcccttactctcctgtatcttcccttacatactgcatagtcccttgtaatttacaagacataaaatacttcctttgttcatctgtatactgaatgtaagaatgaacaaaaggtcatcataaggacagcctgtgagtttatgcactgcatactgcaaatgacccactccagcaatgggaagacacccctaacattgcttctctccttataacgaaaatattattcatcatcagctttaaaatggatcttctcactctgtgcagtctccgtggtaacgtcccataagcccagggttttaagacctttctcctgtgctctaagcctacatatctaactgcctaatggcctttccacttgaatgacacatcattcagtttcagtgtcctaaactgaagtttcaactccaagtctgtttttttctcttgtagtcttcatgtcagtcaatcagtcttttatcctaaccagaaatatgtgagttctcatggattcctccctctcactcacttttcagttctataatcacccagttcctacattgtttgcatcttaaatatctcttctagtcctcccttctcctttatacccactgccactgccacaatgttagctccttcagatctcatattttctcacttttattgctatagacataccccccgcagttatcctacctctaggcaaatcccttccaaaatgcagctgccagtgtgatctttgtaaaatgcttttatgataaagttcaaactcattagcaaagcacacaaagacctttgtgatgtggtattgctgaattaaactactggcagccctagaaaggtaaagtgtatttgatgcttctgtgctgttcccttagcccagaaagcccttccagtttctgtttagtaaagtcctattcatctttcactactcaatgagtcataagtaatcccattaggaaagcctgtgtgatctacctcctccctaatttgccaccttgagtttgcttcaccccttcataatactcagtcaatcataatgtcttataatccatcatagcacctcacacaatgaactccaatgtctggtttgttgggatgtccgccttactacattgtaagcttcttaagggtagaaaccagttctgataggcttagggcagtgaccaccaacagaaaaagtacttggtaaatgtctaacacaatctgttttactttttccagagcacgaggcatgcatgaaagagattaatttactccacatgggaagttactacccaggcttaccaaaaggtcaggtttatataaagtggcgttcctttttttcccccttagtaagacattaaaaaaagaaaccacaattgaaaagccaagagctatctgtgatacggaatatgaacacagaatcagattctcatagcagctaagctgttccccaggcagtggttctcaaggtgtgcttccaagaacagcagcagcagcggcatcacacatgcaaattactggactctgccccagatccacagaattggagactggggatggggcttagcattctgttttaacaagtcctccagatgattctgttgtgtatctagcttgagaatcactgccctggagaatggaaaaaaaaaaaaaaaa

SEQ ID NO: 9421 - DNA, 312 bp, Homo sapiens
tcaaaaccagggctgctaactcagctgacaaacagggaaaaaaactattattccttttccctcaaccagtgcctcccactaccctgcccagaccccagggattcctgggcagataccactgtgggctaccctagccagccttttgcagccccattcctgcttgcttccccacacctccccagccagagcagacctggaccccaacagaaatattcacccctagcggcaacactagcactctcttggacaaatgtttagtgatctatccatcacctgccaccagaccccacttcccttccatcagtggctatt

SEQ ID NO: 9422 - DNA, 312 bp, Homo sapiens
tcaaaaccagggctgctaactcagctgacaaacagggataaaaactattattccttttccctcaagcagtgcctcccactaccctgcccagaccccagggattcctgggcagataccactgtgggctaccctagccagccttttgcagccccattcctgcttgcttccccacacctccccagccagagcagacctggaccccaacagaaatattcacccctagcggcaacactagcactctcttggacaaatgtttagtgatctatccatcacctgccaccagaccccacttcccttccatcagtggctatt

SEQ ID NO: 9423 - DNA, 827 bp, Homo sapiens
atgaacaaaaggtcatcataaggacagcctgtgagtttatgcactgcatactgcaaatgacccactccagcaatgggaagacacccctaacattgcttctctccttataacgaaaatattattcatcatcagctttaaaatggatcttctcactctgtgcagtctccgtggtaacgtcccataagcccagggttttaagacctttctcctgtgctctaagcctacatatctaactgcctaatggcctttccacttgaatgacacatcattcagtttcagtgtcctaaactgaagtttcaactccaagtctgtttttttctcttgtagtcttcatgtcagtcaatcagtcttttatcctaaccagaaatatgtgagttctcatggattcctccctctcactcacttttcagttctataatcacccagttcctacattgtttgcatcttaaatatctcttctagtcctcccttctcctttatacccactgccactgccacaatgttagctccttcagatctcatattttctcacttttattgctatagacataccccccgcagttatcctacctctaggcaaatcccttccaaaatgcagctgccagtgtgatctttgtaaaatgcttttatgataaagttcaaactcattagcaaagcacacaaagacctttgtgatgtggtattgctgaattaaactactggcagccctagaaaggtaaagtgtatttgatgcttctgtgctgttcccttagcccagaaagcccttccagtttctgtttagtaaagtcctattcatctttcactactcaatgagtcataagtaatcc

SEQ ID NO: 9424 - DNA, 312 bp, Homo sapiens; identical to SEQ ID NO: 9421

SEQ ID NO: 9425 - DNA, 301 bp, Homo sapiens
gctgctaactcagctgacaaacagggaaataaactattattccttttccctcaaccagtgcctcccactaccctgcccagaccccagggattcctgggcagataccactgtgggctaccctagccagccttttgcagccccattcctgcttgcttccccacacctccccagccagagcagacctggaccccaacagaaatattcacccctagcggcaacactagcactctcttggacaaatgtttagtgatctatccatcacctgccaccagaccccacttcccttccatcagtggctatt

SEQ ID NO: 9426 - DNA, 589 bp, Homo sapiens
agaaaattattttacatactagcatcactttgtatccatctactctaatctctccagatgtaaatcctcccatcacaagcttcttcctatggattctcttgcctggggaggcatatttgagttgcatttcctccaatgtgcgtcaccttcccaaagaatccaaggatgccatcaacttctgttagagggagcattatgtttggtatagcacatccggtatttggcagagtcaggagtccttcaccctcccaggaactgtactttgaaacttcccataatcctccactgtgatcataatgtttcagctcaccttccaggcaggcctaggaatcacatgtctgggacacacacatgccattatcaccaaatagatttcttgatagtcatttaaaggacccttcactgtgcagtttacagtttcaaagtattttcacacatctcatttgatcctggtgacaatcccattaaataagcaaacaaggttgctacctctgtttcacagttaagaggcctaaagattagagaactgtagatacttgcccaaagtttgacagcagtacagggaataatgccagacatactgactgag

SEQ ID NO: 9427 - DNA, 3026 bp, Homo sapiens
ccatggccagtgactgtggcccgactcgaaaacaaccctcttctcaaaaggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcggctaagccagacagtgtttgctccggttctttccaccgtgggaagcgaacgccacccccacccgcctttgcctgcgagtctccctcgctggcagaagggaagccggccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaa

SEQ ID NO: 9428 - DNA, 378 bp, Homo sapiens
atttacgtatgttacatttttaagtatgagttaaattgatataaagtgttcctcaatatttaataatgtaagctgttgtcatgacagtattttttaaaaataataacgtatattatagttacgaaacacttgtgccagattagaacatcaagcacagaagcagctgtatgatttacctgtttttttgaaactttaatgtttaccttcccctatgtttaatttttctgtggtgaacacttttgttagaacatggcttttttatttttcttggaaaaatatgctattagtatttacaaaataattaattacctgaataagcagtatatactaaaagtcttcaaacattactttattgattacttatgttttgtggtgcgc

SEQ ID NO: 9429 - DNA, 685 bp, Homo sapiens
accaattgtacttttattatatcaggctgattcactgtttctaatgcaatgaacttgacacagattttaaattttttctcaatctgtcccattgtgtagacaaattaattcaaagttctttttcttccttctctttttcatctaagcctgtgcttatgagtagaaaaagagaagaggctaccttgaaatgcctcgggcccaaactcagaaggctctgcactcaactgagcctcccttcctactaagaatggaatagtgttgcttataggggtgttggtccaagtatcagctgtggatgattaattcccagggctgctatcacctaaggtaacttcagtaatcttatgtgtttggaaaggaggatgaggattatttttcaaatacataattttgttttattttgaaacaatctcacacctacagaaaagttgcaattataatacaaagagcttccccctcgcctgaactgtttgatagtaagttgccaaactgatatacccacgatccccaaatgcttcagtgtatttcctcccagcaaggacattctcctgcataaccacaatacaaccataaaagtcaggagattaacaccagttcattttgaccatctgaaattcaggtgtcattcatgttttgccagttgttctttgtatgttcttcatagcaaaaaaaaaaaaaaaaaaaa

SEQ ID NO: 9430 - DNA, 140 bp, Homo sapiens
gaatccagactctgaatatgggtctttgggtaagttaataaagctttctgagtctcagtatcctcatttacaaaatgtgaatacttataatgcctaatttattggattattatgggaattaaatgagctcaagtgtataa

SEQ ID NO: 9431 - DNA, 6609 bp, Homo sapiens; identical to SEQ ID NO: 8257

SEQ ID NO: 9432 - DNA, 10049 bp, Homo sapiens; identical to SEQ ID NO: 8258

SEQ ID NO: 9433 - DNA, 2780 bp, Homo sapiens; identical to SEQ ID NO: 8259

SEQ ID NO: 9434 - DNA, 6609 bp, Homo sapiens; identical to SEQ ID NO: 8257

SEQ ID NO: 9435 - DNA, 10049 bp, Homo sapiens; identical to SEQ ID NO: 8258

SEQ ID NO: 9436 - DNA, 2780 bp, Homo sapiens; identical to SEQ ID NO: 8259

SEQ ID NO: 9437 - DNA, 12041 bp, Homo sapiens
ggtacagtcatcacaagcctgttcggcgggactgtgatggccagagagatgacgatcttaggtgggttcccgggggtccttgttgctcttgcgggcgtagaggcgatctgaggatgccagagtgggcaggggtggttgactcacctcctggatctagctggagcagcggaaggggagtcagaaaggtgacttagagacggttttcggctgttcggagtggatgggggcggggacgcctctaggagggccccggcccctgcaggccaaggtaggatagacggcgaccagctgtgtccatcccagggacatcaggcttagggaggcgttcctttcaacagcacctaggtttttgaattgcctgttgaattggggcaagctatggaaggctgcgagaacgtgcacctccaggacccctttgtggaggaagggggaggagctacatccggatctgtcggctcagggatgctgaatttggaggctttttccatcacatcgggtttggaattacctatcccccacccacacacacacccaccccgcgtctccaaggtgatgaaatgcttctgaaatgttgcctgtagctggaagtggaaagtgggattcgcacttggttttatttctttgagttatgtgttgatgaggatgagctaacaattagtaacacagagccctgaaaattcatgttttgggtcatatgtaatatgagcggacacaggtgtataacacagcctcctgataccaaatacgagattcattaaaaactaaaggggcatctttcttcgcttatgtttacaatctgcgtggcatttgttcctactcttttttcttttttttttaaattagtatttgttgggcatctgctattcctggtctgggggatacaacagtgaacgaaacttgtcttcaagaagctttcatagatgttgccgtcagggttgcccacctttatgcttcttctcccctaaatattaccactgcaagaaggaagtccctagttcatacttaaatacataaaaagttaactgtgttctgttttgaagtgacagtttcatatctaaggaactttcaaaatcattttatcccatttattcatttcatccttttgaaagggaaaaggaggtgagatacgaggagagaattttagacttataaaataataaagtttttcttgtgagaattttaataatggagcttttaaaaaaagataatcgaagctttttataaagctgtaaaatctaaatatcaattgatcaagaatattagattatatctggcttttgctccagataaatgttgtttcttgtcagcatctgcacaaatattattgaaatatttttacattttattacatttattagagaatgacacaaacatacagttatagggttttttgttgtttgtgtttacttcattttaaattttattataaccagtttacattttgaaaaacttgctgtctgagaggagtgctatcagcagtcctataaaaaattttgaaatttgtcttttttagccttgtttcaacgagtgatattaaagggactttgctacagtaatttagtacattgtactagtttgataaaatacatcttttaattttcctttatttcaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggtaagtgattaatctaaaatctatattaattttagtgtactcttttagttaatgctttggcttcatgtcacaaaacattctatctcgtctagttttatctattaatacatgaaagttctgttatctcacataaccagaaattccacagcagctataggatcagttaatcactgactccataatgctaacaggtacttaaggccttgccattttcttgctgtcccatcctcagcatgtcttgcttagctctttcaaggtagcaggaaggttgatgaagccctgtgtaccatagatagatattctgtgtgtgtatgtgtacatatttatatacatataaagagaacataccaggtgtgctattttttgctatttaatatgtcatggataattaataggatcatgtcattatctttaatgattttgtggaatgactattccattattaattagactagtctctatcagtgtacttttttgtggtttttcactaatgttggagattccggtaatatccttacttatctttgtacacttctctgaaagtttcctaacttgaatgctagaagtctaattgataggtcaaatgtgtacgtttttaaggcttttgatttatttttctggtttgctcaccagaaaggttatatgctcttaaccataattttttagagtggctgtatcttcgctagttattttttttaatctttaacagtcagataagtgaaaaatagtatcctgtattaatttttatttattttgattttttttagtgagatcagaatttttagaattttattgatattttaattttcttttatggtccatttttctttgtccttttttgttttggtgtgtttttcttttccttagtgagctataaaagaccttcattatatgtttttgttatcttttccttaccttttttttttcactgatgtttttgagctggatgtcaaagttttaaatttttgattttagactcttatcatgtttactgtagcctatcccatcctatccactgctacttttttttccctcttaatacgtttatgtatttgttggtttggatttcgctgctttttttttcttttaaacatttaaagcttttttccatgtggagtttttcttggaagttatgaagtgaaattctaaatgaagtgaaattctaaatgaattagtttttgtttttttttttgagacagtctcattctgtctctcaggctggaatgcaatggcatgatcttggctcactgcaacctctgcctcccaggttcaagtgattctcctccctcagcctcccaagctggcattacaggcgtgtgccaccacgcctggctaatttttgtatttttagtagagacgggatttcaccatgccggccattatttagtttcaaaatagacagttgtatcagtgctgcttattgaataaacctagccataaaaatgttcaaatttttcatccgttttcaaagaaaaaaaaattgctccctgcatttcttaggtttattactttgttgttttttgacttcttttttgggattctttactgacttacaatctttaatgaaaaaatcatctaaagctatatatgccctctgaattacagctttgggtacgttacttattgacccaaaaactacttaatgtttctaagtgatctgatttttttgttgttgtttttgtttcatgtgggcactgatggttctggtatatttgtatcttagtttaatattgtccatgtagcttctttatgttttccccagactagtgaagtactttttggaaggtcagtttttcatgatggaaacctaactatgaggcctgaagtgagaaaacattcttataatttcttagattaattctcttttttatttatattaatagaatcttggtaaaactaggatagtattttttagagttaaaatagttttttaaatgtacacccacattatcggggacaatgagctaatgcacaatacatgttttcatgggaaacaagaatgtaaatgagatttgattcttggataagtacataatgatgtactaaaattattcttgttaatatgtactagaaaattctttcagctatccattactcttagaaacaagaaatttgggaaaaaaagggaaaagattctgagttacatacttgaatgagcaacttttatttcttacatttcatcatttattctttctttattcagcaaaaatatattgagaatcttttgtgttctagtcatgtgcgtggtgatgaattttattctgctgttattaaaaactagtgtgggccaagcacggtggctttcacctgtaatcccagcactttgggaggctgaggtgagcggatcacaaggtcaggagttcaagaccaacctggccaacatagtgaaaccctgtctctactaaaaatacaaaaattaaccaggcatggtggcacgcatctgtactcccagccacttgggaagctgaggcaggagaatcgcttgaacccaggaggcggaggttgtggtgagccgagatcatgccaccgcactccagcgtgggcaacagagcaagactccatctcaaaaaaaaaaaaagtaaaactaatatggattcattgtacagattttaatgtataacatttaacaagttctaatcttggtaaatgtactagatagatttcaaatgcattttttgattttgtaaagataagggtaagttctcatgaaatctagtatttatgtatatatgtatgtctgtatgcttttactcttttatttatttacttatttgcaaatcctattcacaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggtaacagtacccttgactgagatgcatttttctcaaaattgtgttgggttgaaaaccttctgtagtaaggtttaccacttcccaaaccacacaaccatagtcaaaataaacaaactatatggtaggtgtattagggttctctagagggacaggactgatagtatatatgtgtatatgaaagggattttattaaggtgtattgactcacactatcacagggtgaagtcccacagtaggctggctgcaagctgaggagcaaggaagccagtctgagtcccaaaacctcaaaagtagggaagccaactgtgcagcttttagtctatggccgaaggcccgagagcccttggcaaaccactggtgtaggtacaagagtccaaaagctaaagaacttagagtccgatgttcaagggcaggaagcgtccagcacgggagaaagatggaggccagaagactcaggcagtctaatcctccgacattcttctgcctgcttttattccaggcacactctggcagctgattagatggtgcccacccagattgagggtggatctgcctctgccagtccactgactcaaatgttactctcctttggcaataccctcacagacacacccaggaacaatactttgcatccatcaatccaatcaagatgataatattaaccatcaatgtaggtaaagtagatagatttttatacaggtttataattttgaaagctctatagcacaatataaaatatgtatttaacaagaaccaatcagatgctacaggacaaaggctcaaagagaaaatggacacatgttagcagtgaggaattctttcttctaaattccgttaatgttaaggtgaatataattttttaagtaaaatctgagatagatcatttaatgatttaacatttaatgccattgaaccaatattgagggccttactaaaaaaagaaagaaatctttgttctcatggaacttatgttctaccagagggaaacacagaatgagcataaaaggtaaatttaataatgttttcagcctctacattactgatattttgggccagataattctttattgtggaggactgtcctgtaaactacaaaatatttaacagcgtccctagcctctattcaccagatgctagcagcgccctcctccaccaagtggtgacaatgaaaaatgtctccatatgttgccagatttcttctggaggtaaaatcctgtcttgttgagagccactgatacaatgtatatcagaaagtaaccactatgaagaaaagagcaggctaatgggtcaaggttgcttttggtggtcaggggatggatgacttgtagaatttaaatagggtgatcaggcaaacctcattgagaaagtaacatttaagcacatttgaagaaagcaaaatacttaaccatgcagacgcatggagaaagtgtgttgtaggaagaagagatggccactgcaacagccataagctgggaatttgctggtacatagaggataggaagttggtcagtgtggccagagtagaataagtggtaaaatcagagagctgaagtgaagggtgttatgatctctggaataattctttagagtttgaatgttgtcatagctcctgatacataatgccatactactttgcataccgctcataagtatggcatttagtttaaagcaggaatttcattcaaagaaacctgatcttttacctgctcaacataagcctctttaatttccatagcacttagtgatagtatataatgattaaattttttatttttttttattttttgagacggagtctcactctgctgcccaggctggagtacagtggcgcgatctcggctcactgcaagctccgcctcccgggttcacgccattctcccgcctcagcctccctagtagctgggactacgggcgcccgccaccacgcccggctcattttttatatttttagtagagacggggtttcaccgtgttagccaggagggtctcttgatctcctgacctcgtgatccgcccacctcggcataatgattaaatttttatcgctcatatattccaaagtagaatatgaatgttagaaaaggctgggagactttttgaaaattaagtgttaattaataaagagtagaatgacttattgcactgaaccttggattttatttctttatattgtaatctttcagaataattttaaagatagcatttagaagagcctatgtttactgttcccatttcatgcttctgttcggtttgtgactgctctcattattactcagtggtggagttcatgtcacagaagacacaaacatgctgtaagtgggaagagattacttgatcgcatcctctcatgaatttttcttcccttaaccaatcttacaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggtaagaaaaatgcagggagaggctgggcgcagtggctcacgcctgtaatcccagcactttgggaggccgaggcgggtggatcacgagatggggagatcgagaccatcctggctaacacggtgaaaccctgtctctactaaaaaaaaaaaaaaaaaaaaaattacagaaaaatgcagggagagttgaagaggtttgggcagtgctttctttaacatatccaatgtgtaatgcatcctttttttcccccagaattctttgacttcattttgatagttttctgtatatgtaattttataccatttgtatatatttacagcaaaaagttaaatctcaaaaaatgctgggcatcctataagtcgcataaatacattgccagttacccaattacggctcacatagccagtaggacttttcatggtgatggtgaagaaagggaacagagggaagaaaaatttctttaaaatgaagggtgatcagtatatttcatttaatatgttttataaagtagatgtctttagaaagtctaattgtatttttccctaggaaatgataggattatgcattctaaacccttttttaaacgtttttattttgtcgaatttagcttaagggattcaacctgtttgacacgttgagttgtaagttacaggtattctaacctctgcatttttttttctctttttctaatcaagttaaataccaggaaattatattacactactcttttcctttgaaattatttatctagttttcaggtagaaaagtagaaagaccttttcaggtcctaatcaggcaagaaaaaatgaaaggaaaaaaagagattaaatacctactttttcattataagaagcactttcttctgttgagaatgacattcagtgtttttaaatagctacttataagccaatctgtattcttaatctctatttactgaaaaattatttgatattgtgaagagatacttccttttatataatttaaaattttgaccctgatgtgcactagtttttaaatagtacttatttgggttaagatagctttaacccagtcattattttttaaatttttatttattgatttattttatagaggcagggtcttgctatgttacccagtctggtctccaactcctggcctcaagcaaccctcccacctcagccttccaaagttctaggattacaggtgtgagacaccatgcccagcaacacagttatttttaaccagtctctgtatgaataaaattgtaatgatacatgaaacagggatttgttattcccagaatataatttttacgtatacataataacatacgtgtatacatacacacatatatgcataactatattaaacttttatttttcactcaggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatataatagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccgagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgtttttgttgtttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaattgctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttttttaaa

SEQ ID NO: 9438 - DNA, 12041 bp, Homo sapiens; identical to SEQ ID NO: 9437

SEQ ID NO: 9439 - DNA, 477 bp, Homo sapiens
taagccaccgctcatggccttatgtgggtttattaaggatgccacgaataggttagattccccaatatcatcagaacttaattcaatgggtctaaaatttctgtaaattattgagagttcttctgacaaactatgaaaaaaaaattgctttggtaaagcatttgctttgttttgacaagaattacaaacgatttgcctcacattaagttatttggattttaaagcaggaataaatgcagtttgtttgatacctcattgaattacctattaattggcctacctaaaatacctaaaaaatttcaaatgctctaacacttgtaactctgtaacttattttatatatattatatgtatacatatatatgtgtgtatgtgtatgtgtatgtatgtaaagctaatatgataaaaacacattttttttctgttaagagttcattcaccttaaattacttaacatggactgttggaaactggaaa

SEQ ID NO: 9440 - DNA, 477 bp, Homo sapiens; identical to SEQ ID NO: 9439

SEQ ID NO: 9441 - DNA, 2732 bp, Homo sapiens
gttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccattgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaa

SEQ ID NO: 9442 - DNA, 2732 bp, Homo sapiens
gttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaa

SEQ ID NO: 9443 - DNA, 14083 bp, Homo sapiens
gtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaacccccccccccacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggaatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcagtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataattaaatcctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaatgatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctatagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttgtggaattgagattaagagctgaggccagcatagctctcgacttctccttcccccagtggtccttagcattatatgtcacttgaagtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccacttgggtctttgacttacggcaaaaaattccaactaagaataaagctgaaccaaccacttcctgagcctcagaggctagtaggtcttgaggcacccgggaaacaaaaacatcatagttacagctctgctgccctgagagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaatggctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttagcaatttccatctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaatactggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgttacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttct

SEQ ID NO: 9444 - DNA, 14105 bp, Homo sapiens
gtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccacacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaagagatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtaggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttctggaattgagattaagagctgaggccagcatagctctcgacttctccttcccccagtggtccttagcattatgtgtcacttgaggtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgacagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacgcctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttggcaatttccatctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttct

SEQ ID NO: 9445 - DNA, 7035 bp, Homo sapiens
tattatcagcagaatatattcattctttagaatagatcagtggtggtgtattcatacaatggactattccacagagatgaaaaatatatatgcaaaaacataaattgcataaaccatattgagcaaaagacagacgccaatactctatttacataaagtgttacatacacagagatagattaatacatgtaaatgatacagatatgatagctaggtcagtccacggggatctgtggacttctgaagagtcgtgatccgtgtgacttctgaagagatgagggggcatgggaggctttagcggagcttccgctattctggcaaggtttcatttttgcccggggagctatcagccagcggagagatctgtaagaagagataagacctcaagggaagtacgaggcagagccttccgcggcccgcgccctggcggccccaagtcagcggcggagacagcgcccaccccgctccagcgtggagcaggagcaacggcgtggcccgtggagccccgcctctcgcggcaaccacagagaagccggactgggccacgtctaggaagaggtaggaaaggatcggcgcatcatttctccaatgggaaaggatgtgtttgcggaccaataagtcgccagtataacacccgcccacgcgcctgccaagccaatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggtgaggtcagccggcagctgcccccgaggagcccttcgggatctacagtcccgacgttcagccggcctgcctcgtcctctctgcttccccaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtgaggtggtggcagagttagccgatgccccttatttcccttccgcgtgcctagtccttgcgctgccgttatcttcaagaccctcccaccttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggtgtgtaactgatgtatggataagggtggggatcgtgtatgtacgcagaacgctggataactctgatcagagtgcagtttctttgatcaatctccaaactctttcaggcaggggaagctcaccacacacaaagaggaactctatcccaagaacccttatctccaagactttctgagtgcagaggtgagggcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaactaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgaggcaagaaacatgggtccccaccaatgcaggatgaggctcttgaggccatcttccctgcccttccccaggacaagaggctgaggagttgagggaagagatgtaagtcttggatcatgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatcttttgtcactcacccccgtccagggcttccagatcctgtgtgacctgcacgatggcttctctggggtaggcgcgaaggcggcagagctgctacaagatgaatattcagggcggggaataataacctggggcctgctacctggtccctaccatcgtggggtgagtggaacttagagaagtaaacagtcacacagtggggagggagaaatcagaatcccagtgggagagctgcttaatacaaactactctttcttcaccaggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgtaagtctcggtgctcttgttctgactgcggcaggctacagggcctcctcatgctcccagtcagccgctgtctgttactggctctgttcttgaggcccgagcttgaactcagctgtgatgtggcctctcagatcacactgtcctatgcttgtccagcctggggtcaaacatacccctgattcgtcccctgggtctctctggtgttaatattctgcctccacacattcttttccaggcctgaggccaagtgcccatcttggtgtcttcttacaggccactctgcccttccactgcagtgccatcctggctacagccctggacacagtcactgttccttatcgcctgtgttcctctccagtttccatggttcatctggctgacatgctgagcttctgtgggaaaaaggtatgaagctttgtaaggggttgggtcagtgctgagaaaatgtcctataacgtgttctcttccatctctttaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaaggtgagagctgttggtccttaggagtccttgtcagatttttgtctcatatccatcttcccctaatttctctggggcattctaatgatactgttccctccccaccccttaaaaaggaaaaaaaaaagggctttgaatatcttgatccagctgatggcctgagaacataagaattctgtttcttattcatgcagccacagactaatggtggttttggctttgttctggcagccagctcaccccagggacacctccaccctctgcccttcatgcatgtaccactggggaagaaatcttggctcagtatttacaacagcagcagcctggagtcatgaggtcagtgtaacggttgctcctgcccttcttgccaaccgcaaccctcccttgacttcttacgcacttaatggctgttctctgcccccacagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcagagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgagagagctatgtcactatagataaggaaactcaagaggctaaatgttttgcccaaagtcacacgactcctaaaaacaaaactagaatggccgggcacagtggctcacacctgtaatcccagcactttgggaggccgaggcaggtagatcacttgaggtcaggagttcgagaccagcctggccaacatggtgaagccctatctctactaaaaatagaaaaattggctgggtggtgggcacctgtaatcccagccactcgagaggctgaggcaggagaattgcttgaacctgggacgtggaggttgcagtgagccacgatcatgccactgcactccagcctgggcgacagagcaagactctggctcaaaaaaaaaaaaaaagctagaatggaaacgggcttccacctaaaaatgcagtgtcctttctcttctcctagaaccactaccaccctgatgagtcaagcctttccttagatcaaacctttacaaaaaccacttatcttggatatgaaaactccttctttggcctttctgtctcttagttggccaccttgacctctttttgccaggtcttcaccccaacccgcacctacctcagcaggggtcttatttcccagctgctgggagatgatgctgaaggtctgtggctgtgccccttgctcctggcacatggtgaggatcacacggtcagcttccctgtaacccaggtatcatgattaaccctagggagccacatggatgtggtctatgctcttttccaaacacacatcatccacccttacctaccttgtccacaggacaaccttttccccagtggagctgaccttgctgttattggcacacaccgtagcttctgtggcctttggctgctgttccccctctggacccttgccctgtgttccactgtctttagccaaaccccctctaggggctttgggagaagtctctgaggtgtcaattcctgatggagattcatggacagggcacgtcctgtctcttgtcttcaccctagctctgcttgagggcagccatctctcttgagtgtctggtttcccggacacatgtcttctccctgcatctctggtctttgaggaaacaggactcaggaaggaagcagggggttccacggtaccaggcaatttctcagtttctgatgcatcccagaccagcatcaaagcctctgactcactcactgccttttggccctccctctctttctgaagtctgggggatgccttggggcaggagcgaacctcaggcccaacctggtttctcttaacagtgtacagtacagctccagttgtggggggaaattgaggagtctctggtgaatgaggtggtgggccatccaggaggagccgttctgtaagagtcacttctcgaggggatggcaaagtgccccccactgccaatcctgcttaggaggaaaataaggatcccagggtactgtgaggatcaagatgcacctaagcacgagaaattacctgtggccaggtactgtgcaaaaattctaataaaaaagagtgctgggcatggtggctcacacctataacgtccgcactttgggaagccaaagtggtgggactgc

SEQ ID NO: 9446 - DNA, 6819 bp, Homo sapiens
tgatagctaagccagtccacaggttattagtcgtggtccacgtgacttctgaagagatgaaggggcatgggaggctttaggggagcttccgcttttctggcaaggttttctttttgcccggggagctatcagccagcggagagatctgtgagaagggataagacctcaagacaagtaggaagcagagccttccacggcccgcgccctggcggccccaagtcagcggcggagacggcgcccaccccgctccaacgtggagcaggagcaacggcgtggcccgtggagccccgcccctcacaggcaaccacagagaagccggactgggccacgtctaggaagaggtaggaagggatcggcgcatcgtttctccaatgggaaaggatgtgtttgcgggccaataagtagccgagaataacacccgcccacgcgcctgccaagccaatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggtgaggtcagccggcagctgcccccgaggagcccttcgggatctacagtcccgacgttcagccggcctgcctcgtcctctctgcttccccaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtgaggtggtggcagagttagccgatgccccttatttcccttccgcgtgcctagtccttgcgctgccgttatcttcaagaccctcccaccttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggtgtgtaactgatgtatggataagggtggggatcgtgtatgtacgcagaacgctggataactctgatcagagtgcagtttctttgatcaatctccaaactctttcaggcaggggaagctcaccacacacaaagaggaactctatcccaagaacccttatctccaagactttctgagtgcagaggtgagggcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaactaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgaggcaagaaacatgggtccccaccaatgcaggatgaggctcttgaggccatcttccctgcccttccccaggacaagaggctgaggagttgagggaagagatgtaagtcttggatcatgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatcttttgtcactcacccccgtccagggcttccagatcctgtgtgacctgcacgatggcttctctggggtaggcgcgaaggcggcagagctgctacaagatgaatattcagggcggggaataataacctggggcctgctacctggtccctaccatcgtggggtgagtggaacttagagaagtaaacagtcacacagtggggagggagaaatcagaatcccagtgggagagctgcttaatacaaactactctttcttcaccaggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgtaagtctcggtgctcttgttctgactgcggcaggctacagggcctcctcatgctcccagtcagccgctgtctgttactggctctgttcttgaggcccgagcttgaactcagctgtgatgtggcctctcagatcacactgtcctatgcttgtccagcctggggtcaaacatacccctgattcgtcccctgggtctctctggtgttaatattctgcctccacacattcttttccaggcctgaggccaagtgcccatcttggtgtcttcttacaggccactctgcccttccactgcagtgccatcctggctacagccctggacacagtcactgttccttatcgcctgtgttcctctccagtttccatggttcatctggctgacatgctgagcttctgtgggaaaaaggtatgaagctttgtaaggggttgggtcagtgctgagaaaatgtcctataacgtgttctcttccatctctttaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaaggtgagagctgttggtccttaggagtccttgtcagatttttgtctcatatccatcttcccctaatttctctggggcattctaatgatactgttccctccccaccccttaaaaaggaaaaaaaaaagggctttgaatatcttgatccagctgatggcctgagaacataagaattctgtttcttattcatgcagccacagactaatggtggttttggctttgttctggcagccagctcaccccagggacacctccaccctctgcccttcatgcatgtaccactggggaagaaatcttggctcagtatttacaacagcagcagcctggagtcatgaggtcagtgtaacggttgctcctgcccttcttgccaaccgcaaccctcccttgacttcttacgcacttaatggctgttctctgcccccacagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcagagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgagagagctatgtcactatagataaggaaactcaagaggctaaatgttttgcccaaagtcacacgactcctaaaaacaaaactagaatggccgggcacagtggctcacacctgtaatcccagcactttgggaggccgaggcaggtagatcacttgaggtcaggagttcgagaccagcctggccaacatggtgaagccctatctctactaaaaatagaaaaattggctgggtggtgggcacctgtaatcccagccactcgagaggctgaggcaggagaattgcttgaacctgggacgtggaggttgcagtgagccacgatcatgccactgcactccagcctgggcgacagagcaagactctggctcaaaaaaaaaaaaaaagctagaatggaaacgggcttccacctaaaaatgcagtgtcctttctcttctcctagaaccactaccaccctgatgagtcaagcctttccttagatcaaacctttacaaaaaccacttatcttggatatgaaaactccttctttggcctttctgtctcttagttggccaccttgacctctttttgccaggtcttcaccccaacccgcacctacctcagcaggggtcttatttcccagctgctgggagatgatgctgaaggtctgtggctgtgccccttgctcctggcacatggtgaggatcacacggtcagcttccctgtaacccaggtatcatgattaaccctagggagccacatggatgtggtctatgctcttttccaaacacacatcatccacccttacctaccttgtccacaggacaaccttttccccagtggagctgaccttgctgttattggcacacaccgtagcttctgtggcctttggctgctgttccccctctggacccttgccctgtgttccactgtctttagccaaaccccctctaggggctttgggagaagtctctgaggtgtcaattcctgatggagattcatggacagggcacgtcctgtctcttgtcttcaccctagctctgcttgagggcagccatctctcttgagtgtctggtttcccggacacatgtcttctccctgcatctctggtctttgaggaaacaggactcaggaaggaagcagggggttccacggtaccaggcaatttctcagtttctgatgcatcccagaccagcatcaaagcctctgactcactcactgccttttggccctccctctctttctgaagtctgggggatgccttggggcaggagcgaacctcaggcccaacctggtttctcttaacagtgtacagtacagctccagttgtggggggaaattgaggagtctctggtgaatgaggtggtgggccatccaggaggagccgttctgtaagagtcacttctcgaggggatggcaaagtgccccccactgccaatcctgcttaggaggaaaataaggatcccagggtactgtgaggatcaagatgcacctaagcacgagaaattacctgtggccaggtactgtgcaaaaattctaataaaaaagagtgctgggcatggtggctcacacctataacgtccgcactttgggaagccaaagtggtgggactgc

SEQ ID NO: 9447 - DNA, 366 bp, Homo sapiens
acagtagcgtgatctcaggtcatggcaacctccgcctccggggttcaagggattctcctgcctcagcctcccaagtaggtgggattataggtgcccaccaccgggcccagctatttttttttttttttgtatttttaatagagatggggtttcaccatgttggccaggctggtcttgaattcctgacctcaggtgatccacccacctcggcctcccaaagtgttgggattacaggcgtgagccactgcgcccggccacacactcttaattctgcaagaggagtgaggccataggatagaaaaagcctgaacaggagaagggcttcttatgggtccatcagtgaaagaggtggtatgtccatccctg

SEQ ID NO: 9448 - DNA, 322 bp, Homo sapiens
atatatatatatatttttgtttttttttttttttgagacagagtctcgctctgtcgcccaggatggagtgcattggcgtgatctcggctcactgcaagctccgcctcccgggttcacgccattcgcctgcctcagcctcccgagtagctgggactacaggcgcccgccaccacgcccagctaatttttttttgtatttttagtagagatggggtttcaccgtgttagccaggatggtctcgatctcttgacctcgtgatctgcccgcctcagcctcccaaagtgctgggattacaggcgtgaaccaccgcgcccagcctatt

SEQ ID NO: 9449 - DNA, 1074 bp, Homo sapiens
cacctgggcttcttgttacctttgtctctggtgtggaggaggagagatggcatccagtggacagaggagttcatttttcagggatgacttggttggtctgccttcctgggccagcgtgcaggcaaccccactggggccagagcatcctctccgtgagttctcatagcttggatctaaccctggtcatgttggatttccattcctcctggccttaagttttttttttcttgtttgtttggtttttttttttggagatgaagtgcagtgcagtggcacaatctcagctcactgcaacctccgcctccagggttcaagcgattctcctgcctcagcctcccgagtagctggtattacagacgcctgccaccgcacccagctaatttttgtttttgttttgttttgtttttttaaattttattagaagtgaggtttcaccatgttggcctggctggtcttgaactcctgacctcaagtgatccacccacctcagcctcccaatgaaggtgttttttgaccattcttataccttctcttctgtctcagggcatccctcccccattcagagaccaccatcaagggtcaagggtataactagtcctgattcccaagcaaggggccaaaggtgtcagccaggtagatcatgcttttcctttttgcacctgttgggtcttcaaattctttctttggtaatccccattgttttctgtgagctggtccttttcctaccatgcccaggttgaactctccatctgcctgcccagcttgctggaaaggggcatgtgtttatggtccctgtcccatcaggagctccagcctgttggcaatttctctcctgatcctgcgttggcgtcctcagggctttgctccccggggtcccctgagtggccttctgtctctccgtggtttggatgcagtgcccacgagcttgcctgagtgcacaggtatccctctcgctctcatggagcagcttgcagggggctctgtgaactggtccctgtgcctacttttggggatcctgtgataagcagtgtcttcctgagtgcccccttctcactgtggacatcagaggcccca

SEQ ID NO: 9450 - DNA, 556 bp, Homo sapiens
gggtcatagaaagtagctaggaagttagccttcaaaaacctgggaaaaggaactagattttatactctccacctctgagaaacacagggccattgagcctttctctttttgccctgaatcagaggaaatagcattctggtgcttggggaaggaggaggggaaagaaaccaccttaccctgtaccatggggataaggatatcttgctgggctgctgagtggtgtaatgtatatcaagagattggccttttctagacatttaatctgtgatcagagtcttaaggttgtactttgattttccaaggaatgtaagtacgtcattgaggttagggtcgtttaagaagcccacctgctctcctatttctggatgtttagaaaataagatagacttttagatattcttgcagatgctaaggagatgaaactttttgagtttctttttctttctctatttctagaatttattcccttgtttttttccttcaaaattattttatcaccccctccccccatttttttagtgcttgttttagatcttggagtcaggaagtttctgaa

SEQ ID NO: 9451 - DNA, 2230 bp, Homo sapiens
agagaaagcaccctctcaacagtgcaacatcttttaaagccacctataatgaaagaataggtacaatggggacagtgtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatatcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattcaacacagattgactcacagtctacctccacagcatacaccccaaaaattgtccagctcatctccaccaccacccagttcagcctgtccttttcaaaaacatcaatcttatgttattccaggtttaaaccctctaatgtgttcccatcacacttcagttaaatcctactcctcttaccatcacctgcaaggtcttacctgacctgattccctcctgccattccagcctcagctcaccttgctcagcacactcccacctcccatgtgttcctcctgtctacagcctttgaattagtcattccctcagcctagaaagctcttcctccaggtctctgtgtggatggctccttctcatcactggggtctcagctcaaatatcatctcctaaaagaccacctgtctgatcctacctaattgcccctagcccagaaactagtctcaattacatacccctgtgtgtgtgttgggggcaggaggttgtcacttatcactatctgaaataatcatgtgtgtttgtttcttcgtttattgtctgtcttcctggactgaaacggaagttctttgagaacagaggccatggctaaatggtccctggagcccagaaccaggcctggcaattgtagaagctcagtagatatacattgagtgagaaaacgatgaatagctgagttaaatctcaaacttggttctgaggaaacccaacatggaacaacttgtactaggtcggtgcaaatgtaattgtggtttttgccattatttttaattacttttaatggcaaaaaaacgcaattacgtttgcaccaacctaacacattctagtaatatatttcttgaaacagcaccaaaacatttccatgcttaaccccattcttaaacactgatgtgacatttgaggtcaaactggaggagtaaaggaggaggttgtgataattatttcatgcctgtaaaatttgacctgagaatttggggataaatgatcaaagtattctttaaagttctcaagaaagaataaaaaggagggtgcaaactctggttggcactttttcatatttttttctagtaaggaaagcttttggcttagttgtcttgagacctggctgccatcattaggaaaccacaaattaggatagaaatagcttcataaatgtgacaccatgactccatcgcctttgaaactactgctctactctgacccccagggagatgtgctcacatcagagctggaataaaaaaatttaaaaataaaattaaaa

SEQ ID NO: 9452 - DNA, 2230 bp, Homo sapiens
agagaaagcaccctctcaacagtgcaacatcttttaaagccacctataatgaaagaataggtacaatggggacagtgtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatgtcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattcaacacagattgactcacagtctacctccacagcatacaccccaaaaattgtccagctcatctccaccaccacccagttcagcctgtccttttcaaaaacatcaatcttatgttattccaggtttaaaccctctaatgtgttcccatcacacttcagttaaatcctactcctcttaccatcacctgcaaggtcttacctgacctgattccctcctgccattccagcctcagctcaccttgctcagcacactcccacctcccatgtgttcctcctgtctacagcctttgaactagtcattccctcagcctagaaagctcttcctccaggtctctgtgtggatggctccttctcatcactggggtctcagctcaaatatcatctcctaaaagaccacctgtctgatcctacctaattgcccctagcccagaaactagtctcaattacatacccctgtgtgtgtgttgggggcaggaggttgtcacttatcactatctgaaataatcatgtgtgtttgtttcttcgtttattgtctgtcttcctggactgaaacggaagttctttgagaacagaggccatggctaaatggtccctggagcccagaaccaggcctggcaattgtagaagctcagtagatatacattgagtgagaaaacgatgaatagctgagttaaatctcaaacttggttctgaggaaacccaacatggaacaacttgtactaggtcggtgcaaatgtaattgtggtttttgccattatttttaattacttttaatggcaaaaaaacgcaattacgtttgcaccaacctaacacattctagtaatatatttcttgaaacagcaccaaaacatttccatgcttaaccccattcttaaacactgatgtgacatttgaggtcaaactggaggagtaaaggaggaggttgtgataattatttcatgcctgtaaaatttgacctgagaatttggggataaatgatcaaagtattctttaaagttctcaagaaagaataaaaaggagggtgcaaactctggttggcactttttcatatttttttctagtaaggaaagcttttggcttagttgtcttgagacctggctgccatcattaggaaaccacaaattaggatagaaatagcttcataaatgtgacaccatgactccatcgcctttgaaactactgctctactctgacccccagggagatgtgctcacatcagagctggaataaaaaaatttaaaaataaaattaaaa

SEQ ID NO: 9453 - DNA, 190 bp, Homo sapiens
taaacatacacaaacagatatatatatatggcatatgattaatgatatctatgtttatatgagaatggagaaagctgtgactgcatgtataccagtcgttaaagctgattgcatttctgaaaatgaggagctggagtggtgagaaagtagaaggaaatcaaagaatatacatgaatatgtgaattcatca

SEQ ID NO: 9454 - DNA, 190 bp, Homo sapiens
taaacatacacaaacagatatatatatatggcatatgattaatgatatctatgtttatatgagaatggagaaagctgtgactgcatgtataccagtcgttaaagctgattgcatttctgaaaatgatgagctggagtggtgagaaagtagaaggaaatcaaagaatatacatgaatatgtgaattcatca

SEQ ID NO: 9455 - DNA, 5366 bp, Homo sapiens
cttaatagtcaaattctatatatggtgtcttcctttggaacaccttaccatgggctatttggtcagctccattgactccttgccttgggaattttagtgcagtgagagttgtgctcacttctccttcacttcagggcctgatgtgtcaggaaatggagttttctgaattaacatgaaagttgagttgcagattgcttggttaaaaaacaacaggtggggcacagagtctcatacctatgattgcagcacttcgggaggtgggaggattgcttgaggtcaggagtttgagaccgacctggccaacatagtgagacccccatctctattattttgaaaaacaacagcaaattttttcttaacatccaagacaaggccaccagtcaaaactatcaagttttagtagtattttcctgcttgattatataatagcctggcttagagatacaacctttaaataaggaatcttaagatgatgtgcagctgttctttgccttatttgtttgtttgttggttagtttgtagtttctaagaatctgctctgttcagctgtacagttccttcttctggagttaacctgtggcaaggattatgtttcacctgtcacaaaaatgagatctgtgccttcctctattataaagttagggcatgtgattcattcttcgaaatacttcaaaatgtactttggtatgtttttgtcttgaaaagaggttttctagctagaaattcggggcccagaaggtcaaggctccagagatccccttctcatcatccttcagttgtctgaggagacagaggatcacatgtgtcacagtgagtgctgattccccagaatctgcagtcttaagctcccctgctgacgcacacagccagttctctgcttcatattcatgtgacccactgtgaagtgacaggcagctgccaattctgtcatataagaagcagctctgcccatgcaactttgaaagttcctgcacttctccatagactgctccttcatggaaataaacacatcatcacactgtgggtgcctaagctaagtttgtttgcagtttgatgatgcccagctccttttcaactcagccttaattggcactttaagggccaggatgaggtttctctcaggccaagtcgagatttccagatttccttttgtccaaggctgaccagtttagaagttattcacatccttgttttagttctttccttcttgtcctggtacctcttcctttccaggattatttgcagagtctgtgatggcttacttggtgaccagacatggggtgagctactggtatagtctgattactttggcatctattctgaactggtcattggctgtacatgagtttttgtgctggtaaaggaatatactgggaagattggaaggcacagactgggaactaattctgagaagagaactgctgagttactgaaagaccttttggaccacccctaaatggagcatcttgatagatggcaaatccagtgtttcttaaacttgtccatgctgcccagagcccactgccttttatcagatgtgagacttcactgccacagtgtcatcccacagtttccttccctggacatttgataaagggaaaatcatttcttgtcctttaaggcagggactattattttttcacttttccacataccccacaacacctaacattgatttactcgtagtaggagtttcatactgttgaactctctaaaggccatttgttccagggcctagctgggcttgtgaaggacaacagagtcatttcctaaggaccccaaaagacagcatgaaggaaaaaataataataaactgctgttcacagtgccttgagtgtaccaccgtactttctgctatgccttgtccattccaatctggacagtctctgtgcccctcctttccactcaagtgttatccagcactcaagttctggctcaaggcccaacatctccgtggggacctcagccatcccagggcattgtgaccccttcctctaagtccccggcacactcgctgattggtaccctctcattcgacaaagcatatgccattgtggcttacttgtcatttctttaggtcttgccttcccaagtagatcatgagccactataagaactagctcccatagtcccagcccctgggcctggtacatggcaatgcttagtgattggtgattgaggataatggtggtaaaggatgtaccagacagtcatctcctgaagagatgccgaacaacctgtccttgttttatgtattttctctttctttcctgtccagttttattcctctcatagtaactgctaaaaaaatatcagttcctgtcactcttccaccccttttctccctctcccctgcattgtggtctgggccttggtccactagcaactccccttaggtgttgcttaatctgcctcatggccaaagccaatcccattcctgtcccccgctacccaagggactcccagtctgtatgcacaaggcgggatgtgaagtctggatgtgcaagaaacccagctgtaagaaacagcttccctcggcttggcatggtggctcatgcctatattcccagcactttgagaggtcaaagtgggagaatcacttgagcccaggagttcaggactagcctgggcaacatagcaagatcccacctctacaaaaaaagaaaaaattcagagtctcaaatgtcccttcatctccttactctcgacctgtctccctagttctctgccgccttttcctctcccctggatctgacactcaattgtctgcatgcacttttcaactgaaagagactccaatgccatccttctgatgaaatttttgctttggatactactgcagaaaaaatgctatcttgtattctggtccatggtggggaagaccctgtcgtagaacctggcaactcaagtggagggaggggccagaacattgttcttatgctatttacagtgagacaacaggattgatgcagaactttctttttttttttttttttttgagacagagtttcattcttgttgcccagggctggagtgcagtggcatgatctcagctcactgcaacctccaccccccaggttcaagcagttcttcctcagcctccggagtagctgggattacaggcgtgcgccaccacgccccactaatttttgtatttttggtagagacggggtttcaccagtgttggccaggctggtctcgaactcctgacctcaggtgatccacccacctcggcctcccaaagtgctgggattacaggcatgaaccaccgtgcccggccgtgatgcgcaactttctaataacatacttttgaaagtgcccagacatacatccctcctctggtaccacagtggccatcagttgccagagaacatgaaattatccagccctcagctctgcagcaggattctgaggagtaaagcaggcctgtaaagtactctaaagtacttcagagaggtaatgccacaaagcgaagaacacctcttggaggcagagcccctcagccctatccaggccagcagtgtccacttgaaatctgaaagcagcctccctcaccaaaccagcaagatggaaaacctccctgggttggcaagtggccctgggaagtacatgccccatctctgtcaggatagcagtggagaggtttcgtgccagtgccagctccacccacccagatggtactcaagactccaagcctgtcaatggggtggaaactttctggcattttctgtcagaagggtgagttagcactgaaccatctcatgtgtcttttcactgagtaacagcccatatccattccatgaaatgagtgactgctttgttgaatcagatagtaacaaacatttatttgtagtctggttgtgtcatatcatggttgaattgcaaacaggttggatagaagagtcagcaaaaatcaacaaaagcattctgtaaaaaacttttctagaattacaataaatggcattgtatattttatttataaattatgtgctgcacatcatttttatcaatgaaatttataataaatttctgtacatatatacatttttatcccagagagccagttgttaagcatttaccagcaataaatgctttttgtttcctgcttacacaggttctgggagtggccagcccactctttgagatgtccccacttgcttttttagttgtccaagtagtgttctgcccagccttcccgactctctttcttatccttccctcgaaactattctgttccttatgcttaaatactttccagtcatgggagctttgctgtaggcccttggcctttcatgggtagcttctgatacgtgcatgggtgttaatagaggaagttgaccccgcctgggaagaataatgacctatggagacctggccctttctcttatggcttcttaaagtgacagctgttatgggaagttcaggcatcttgacgtggaaaatacattgttcattttcttttaattttttttcccctaaccactataccaacagggatggaaagatacttttagttggaaggaatttggagcccttaaacgacacctggagcagctgcctgtgggtggggctttgcacagtctcatcctggcaagggaggacgagccaaggaccagttttgcagaattgtcatcatgaggccctggttgtgtgctgggctggggcattgcccctttccaggaggccaggccaagcagggctgcctggcttaggcttttgcatcttcagcatcctttcacgtctcttatctcaggtgaccttcacagcaagcctggtgaaggttattgagaagcagatgtcaccacctagtcttagagctgatgaaagcaggatgtggggaagtccagaccctctcctgaaaccccttggccacctgagctagtaccagagcaaggtcccacttggccgtgagtgctgtctctagggcctatttcaggaactgtctcatatataagaacagaacactttttgccagctataccaaatgtttttgggattaaaaaaatagtttctcttttccaaattaggtggtaagaaaaggaagggcattttcattctcacattctttgaatgttgaaacgttttaaaaacttccagctgggcttggtggctcatacctgtaaccccagcactatgggaggctgagatgggaggatcccttgaggccaggagttcaggaccagcctgggcaacatagtaaaactgcccaaaatttgaaaattagccttgtgtggtggtgtgcactgtagtcccagctgctcgggaggctggggcaggaggattgcttgagcccaggagtttgaggctgcagtgagctatggttgtaccactgtactccaacctgggcaacagcgtgataccctgtc

SEQ ID NO: 9456 - DNA, 442 bp, Homo sapiens
ctcaaactcctgaccttgtgatctgcccacctcagcctcctgaagtgctgggattacaggcatgagcctggttgagacatggttatttcatcgcaatatcttggggaacccatgaatgctctgaaatgcctttggtttagaaatggatgaaggagaggccatggaaatatttagaccttttggagagatcgaaaggacaggtgatttatctccaagttcacctcgagacatgacttgggctgtcaaatgttcttacggtagcctggcaacatgtctttctcagcctggtctgtacagtgtggaggaagtaagggactttattaagagtgtcacaatagctataacctgccagtcaggtgatctgtttttccttggccatctctccgtctgctcaccactcttttttccctagtacacgaatatctttaacattcaaaaatat

SEQ ID NO: 9457 - DNA, 153 bp, Homo sapiens; identical to SEQ ID NO: 6795

SEQ ID NO: 9458 - DNA, 142 bp, Homo sapiens; identical to SEQ ID NO: 7402

SEQ ID NO: 9459 - DNA, 14626 bp, Homo sapiens
actgtgatcatcaaaatagaactgtgcagtacttaaaatgtaagaatctgcaaaaacaaaactacagaacaaattccgaaggtgacctgagaagaccaaatggataagctaatacatccaggtgtctccgattatattatgataaagtgtagggaggttgaacgttacataaataccactggatatttttctttgttagatgtggccccatggtattggatgctttaatcaagattaagaatgaagttgactctactttgaccttccgaagatcatgcagagaaggtgagcatttcattcctgttgggctccagatacttgtggtcttccaaagaggcttgggctggccaaagctgatagagacatctggaaaacagctgcagctctctgctgggtgaacttgctgtgcaacctaattccttttcttgggtaaatgcatccaaaattctaaccatggtgcaagttctggtttctgagtttactttccttcaggagcattctatcctgtggttactgcatctggcggtccctgtgagctgctccacgcttcaaggcctagctaggacctgctggctggcaccttccatgctgctgagctcttttattaagggagcagtggagagtttctgtctggcacttatgcttgtccagcaggggagatgtgtgagtctccctcagctcccagcatgacatgtccttggtagctgtgttctggattggctggtacagtgtctccctcagcatgtggttacttgtgctgctggtgccacatgagcccatttgaggcagtgtgcagactaacattttctacatgaatagcaatgtattcattttctgtattagaaaaatataattactgccgggtgcggtggctcacacctgtaatcccagcactttgggaggccgaggcgggtggatcagctggcgtcaggagttcgagatcaacctggccaacatggtgaaaccttgtctctactaaaaatacaaaaattagccgggcgtgatagcggacgcctgtaatcctggctactcgggaggctgaggcaggaacccgggaggtggagtttgcagtgagccaagatcacgccactgcactccagcctgggcaatagagcgagacagtctcaaaaaaaaaaaaaagaaaaatataattactaatgatggtataatagggatataagtggttttttaatgtgaatttaagcaaaacaagttaaagaaaacccaagagatactttaaagaaagttgattcaggtggttctcaggtatagcaaaaattgcacagggtgcagtgaagaccgactggcctgatgtccgtggagccagactgtgtgcccggctctgttctgtgcactggacatgaggtagatgactgtgcttattatctaccttcaatttaaaggtgaggcccagagagggtaatggacttccacaaggacacatagagagtgacttgagagccgggagtcagccaaagctgtcagactccagactccagatctgctctctcaggcactgacttggcttggaacacctgggataaaacaaaagcagagagtagcttgattctgtgaggacactgagcttttttctaagaaaaccttaaaaaaaaaggaaaagccagtattgataccggcccatggctttttatctgttcagctgtacatttcaagcatttcaagtcttttaagacatctgttttgattcagctaatcttatttagcgttgcaaatgctgatggatattatgatagttcggctgagtcctgctgttcagggaacattctgcggcagttaaacagcagccttccccattaagtcctggcaacacaggaaaggtagatgcttttcagtaacctttccctgtaggactctttcagaaccaagaacataaggtgtgacccatctggactaaaaaaaataaagcagaattgtatcaattgctactcctttttattcccatcttgtttttcttattttttttttaattcccatcttgtaagagaattcccagggagcctttttgagagaaagttcattggatttatttttttaatttttatgccatttcttgtaaaagcaaactgctctagttggatgccaggtatacataaatgtattgataatatccagtctcttggggaactctaggagtatttgcttaagacacatctttgggttcccttacactctttctaagatttacaggagaaggagagtcttactgtcttttctagtcttatgaaagtgataaccgactgggcgcagtggctcacgcctgtgatcccagtactttgggaggtctaggtggtaggctagcttgaggctaggagtttaagaccagcctgggaaacatagactccctttccattaaaaaaaaaaaaaaaaaaggtgaggccaggcattcagaggccgaggcgggcagatcacaaggtcagagttcgagaccagcctgaccaacgtggtaaaaccccgtctctactaaaaatacaaaaattagccaggtgtggtggcgggcgtctataatcccagctactcaggaggctgaggcaggagaatcacttgaacccgggaggcagaggttgcagtaagccgagatcgtgccactgcactccagcctgggcgacagagcaagactccatctaaaaaaaaaaaaagatgataaccagtgcaactttctcaagcaatcaggtttctctgacctaatgatcttcaaaaaacagcttcagaggactggcactagaggtttagagtacataatcatttttaaattccaaaacacccaggaaatttccatatacaggaagtaggtccaggctaagaaaattctcatgtcggggtcctgggtcagcacgttttttgtttagtttgctttgctttgcctcagtttcatattagttcattcttctcctctttggaaagtccatgctgagtcagcttttgtggatttcatagccccagggtactatgctgcgtattttatgaagacaatagaagaagccttacctctgtcaagtgtagtggctcaggcctgtaatcccaacacagtgggaggcaaaggcagaaggattacttgaggccgtgagttagagaccagcctgggcaatatagtgagacacctgctctacaaaaaacaattatttttttcttttttttgagatggaatcttgctctgtcacccaggctggagtgcagtggcgcgatctctgctcactgcaaccttctcctcctcagttcaaatgattctcccgcctcaccctcctgagtagctgggattacaggcacccaccacgacttatatttttagtagagacagggggttaccatgttggccaaactggtctcgaactcctgacctcaagtgatctgcccacctcagcctcccaaagtgctgggattccaggtgtgagccacttcacccaacctacaaagaatttttttgaattcgccgcacatggcggcatgtgcctgtagtcccaactactcaggaggctgtggtgggaggatcgcttgagcccagaagtttgaggctaaagtgagctacagtgagctatgactccaccactgtacttcagcctgggtgacacagcaagactcagccaagaaaaaaaaagaagaagagctatctcttaataatctgtatccaggtcacttcaaccttaagatgaccaagacaatgttgatttactttacttttgggtattgtgtctgttagatttgtgttcaaataacagtggctttaaaaaatctaggtttccaggcgtgagccaccacacccacccctactcaggaggctgaggcaggagaatcacttgaactggggaggcggaggttgcagtgagccaagatcgcggcattgcactccagcctgggcaacaagagcaaaactccttctcaaagaaaaaaaaaaaaaataggcttgacgggtgtgtggtggcccagacctgtaatcccagtgcttcgggaggccaaggcaggcagattacttgagcccagcagttcaagcccagcctgggcaacataacaaaaccctgtctctgcaagtctcgtctctacaaaaaataccagaaaattagctgggtgtggtgggctacttctgtagtcccagctacttaggaggctgaggtgggaggatcacttgagctcaggcattgaggactgcagtgagctgtgattgcaccactgcactccagcctgggtgacagagtgagaccctttctttaaaaaaaaaaaaaaaaaaaaaaaaaaaaacaggctgatttttcttcaaaacacgtgacacatggagctagaactgctgtggaaactccatggtgccagcagcgcccaggcctctggcctcctccagtgccatacttggcatgtggcttctaacctcaaggttgccacatggtcatagagtagtttttggaactcaagccattagaaccacattcgaggcaggaagaaggaaggaagggagaaaagccaacaggcacctctgtcagaggaatgttgcatgtcagtgctgcccctgatggcacagcaaggaggatccagaagaaagtatttggggcaggactgattccggatatgggtgaggatgtgttaaatgtgtgtctctttcaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgtgagtttctgcatctctctggttttgtttttatttgcatggggggcagtgctatgtgtgttacgctattagtttttcagggcaggatttgtttgagtatttaaggctcctcttctagtcagatagtaaatagatgggactgtttcctatattatggcaggaggaggaccacagtgtcactgagagattaggaaaatctccagatctgagacagtgtggccagagtttaattaaagaatttgaatggcagaagataaacgcctagaaaatcctccagcagctcatttggtgaggtttgtttgagaataatggggcacagaattttagaattggaacattcccagaaatgaataatttggccataactacaaagaaatcatgtggaaaatgccagttgggaaagcaacagctgtttatgagtcccactttaatttctacctccctatatttgaacacctttgctgacgtggtgttttcaagggcagaaaggactgtgggattggcaggtttcccaagtaggtgagggagaggtttcctaaccatgcttaacattgtgaccatttttccttttgtaatctttgcatatattcatgacaaaggaaaagagtctggcttctgcctggcatagagtggacgagtagtcagtgtccaagaaatggggtaaataaagctgaggtgatgatggaatctgatccttttcttcttcttcttcttcttcttcctcttaaccacaggatttgagcaacttctatgcacagtacaaatccattgagccttatttgaagaagaaggatgaatctcaggaaggcaagcagcagtatctgcagtccatagaagagcgtgagaaactggtcattagtccctatttattgtttcaatctgaagaatttattgcaaagatgattgccaggagtgtggcttggcagggaacataagctgatgcaagccatttagtgtattctggagaggaactggcacaagggtggggcactcatcctcttagggccgggtgagtagtgtgaacccgtgaatggcccagagtggaccaaggagctagagccctgtgccccgcctgcaggggcgggtggttgctgtgtggctactccatctttttcaaaagaaaccagtatgtaaattgcctgggctttaaaaagtgaccactaagtcagaactgttccctcactgggggcaaaatgaaacacatatgctggccagttgtaactaccaccgtcctgctttacaaatgggagtgaaatgttaatggcaaaacagagtcatcgatattctttcctgacaccatacttctggtgatctgtggggtgggattattcctggcctgctcactctctgggagttgccattcctgtgtacaagctgtaaaatcttaaagcggaggcatcattatcaagttttcagtctttcttcttctacactacttctactcctctgcgaagaagtcttctctgatttgcatactccctgcatacttgtggacgtgaggtaggaaggggaccaaatggagacagagccccacctgcaggtctgcacagggccaagggcaatggctgtgtcttcttcctttctggatccctaggccctggcgcatgttattttatccataaatattagttatgtaaatactgtaaaaatatatataaattttttaaaaggccagatgcagtggtgcattctgatagtcccagctactcaggaggctgaggtaggaggatcacctgagcccaggagtttgagagtctgagagtttgaggccagcccgggcaacatagcccaggttttgtctctaaaacatatacatatatgtgaatatatgaaaagtatcagttgtatgaatgaataaattaattctaccttttgagacttggtaaatatttagcatcctctcctgttgcccataaaacgttaagaaaggggagtccggccaggtgcagtggctcatctgtaatcccagcacttagggaggccgaggtgggcggatcacttgaggtcagttgttcgagaccagcctggccaacgtgataaaaccccatctttactgaaaatacaaaaattagctgagtgtggtggctcacacctataatcccagctactcaggaggccaaggcaggagaatctcttgaacccgggaggtggaggtttcagtgagccaaggttgtgccactgtacttcagcctgggcaacagagcaagactccgtctcaaagaaaaaaagaaaagagaaaaaggggagtcctagtaagtgtgcccagtctgtcaccatcaagatagtgagggtcagcacagtggcctgcaagtcagagtaagcctgggatgagacttcagagctgctcttctcagactgcagctctgctcctcagtttctacctcccagagtcttgtgcatcccagagtccaggctgaaccgggccctctggcccagcgagtcctttgcattcctaggcaaggctggtgcgtagctagtgaacatctccctgatgtggtattattagggattgaagagttcccctgagcatgtttggttttctagatacaagttgagtattccttatcctaaatgcttgggtttcagtgtttggggtttcatatgttttcagattttggaatatttgccttacacttactagttgagcaccccaaatccgaaatctgaaatccatgctccagtgaacatttcctttgagcagcatattggtgctcaaaaagtttcagattttggaacattttggatttcagattttcagatttgggatgcccaacctgtaatagaaatttactcatttactcatttacataccaaacatttaacattttttggcttccttaaattagtatgctgaacttaataaataattggaaaatgtggagaaatttatgtatgtatttatttttaattgggcagcccccaaaccaaaataggttcagagaggctccatcattttttaaataagctataattttcagcctggggaacatagggcgaccctgtctctacaaaaactttaaaacttagccaggcatggtggtatgcacctatagtcccagctactcaggaggctgagatgggaggattgcttgagcacaagagttccaggctgcagtgaactgtgattgtgccactgcactccagccaggggcacacagcaagaccctgtctcaaaaaaaaaaaaaaaaagaatttataattccaccaccaaaacataatctctgttaatatttatagtttcctttgttttttgtttattacattatatttttatgtagctgggatcaaaatgtaaatatgcttttatatcctgcttttttcacttatgttattgtgagcattttcttcatattcttaaaattgttcataagcattaacttacactttgctttctactgcttcagatgtatgcaccatgcgccataaaaccatttcactgttgctggacaatgaaattgtttccaattttttactgttagaaataaggctagatgaacatctttatccttcaagttctgcccaaaacattctaatttcttattacagatttttctaggagtgggttaaagaatatgactattcttaaggctcttaatcctgtgaccttatgccttctagaccagtggggccagttgacactcccaccagctgtctggacataacatagatttggttgaagactcatggttcaatcacaaccatcagttctgtctcatctgttctcaactgtcacttcaggtgtcagtgggcccctttcattttgctgtttttaatccatttctgttgtttccaaactcagaaagtccggtttgtgtttgggacttgttgggcagattgacccagtgtggcaggtgtgaaagtgcaggaagccagagccagctgccggggccacatcctggttctgctgcctatagtggcacgtccctgggcacatggcctaactcactctcctcgccttggttccttacctgtaagtggaacttgctggagtcacctcacaggattactgtgatgatcagttaaggaaagcgtgtaaggcgcagggcctccgtcaggattggcagtggcagtcactggggatgatgttgatgttcccagtgaaaacctgagggcccttctgctgagcccagggcagaagcagctacagactcttgctgcttcagcccctaggcttttgaatctctcccgtcttgacctcattccaggaagctggaatttatgggagttgtttttgtgttcttgttttctatttcttttttagacaagtgagaggttcttgtttattaaagggaaagtgcactatacgtggatttaagaaccctgggcagatgtttacatttcacttgcaagatctttattaatctgctaaatatctgcaaatcaccccttggattttgctaagaaaattcacatgcaagtaggcactttgttcatgcactgaccccaaaggtaacatttaatcagctgaagacatagcagagtctctcccgtcacaagctcctgcctctcttttctccccatacaggacgggctctacgagtgcattctctgtgcctgctgtagcaccagctgccccagctactggtggaacggagacaaatatctggggcctgcagttcttatgcaggtgaggtgctccttaattgctttaagagaaattgaaactcaagcatccagaagtccaagaggacaatagattgctgtaagccagccattctgaggggcctggtttccttcattgccatccagtccaaacagggtaattggttgcattgtattcacttgctttcggtaaatctggggccttgtctgcaaattgcctttgtttcagtgcagtgagggtcaccccaaaggggtgcaaaccatgccttgcagatgtttaaaatgtatttccgtttgcctggtggtcagaggctccccctctccctctcataggatttgtaacataagacttgtagcgagcaagcaggggagaaagcagtgtctttgaagggcagctgcccagctatgagattggaagctgtttcccagctaatgaaagcctggatttaggggttgcttagaaagaaaatagtattgatgttcactgcaaagaaagtcactgtctttgttcccagaaagcttgtgcttttttagatacgtgcttttcacagactctaggcaactcaaaaaccaacttctctttctcattttcccacaaaaagagaagttacaggtttgtgtgaccacatgagcaatattgattcccagccatgtgaagattggataatgaagtacactcatacttgtcacttttgccagctgctccgagttggggatgtagaggtcctctaagtaacactgctagagcaggcctatggtcatgtgattaactcgtttcagcctgctgatctcaggctgctgagagcgctgtgtaagttcaaagaatcattaagtgggacaaatactatctgtagacaggtctgttaaatcattcctttactcagagacagcaagtccagcatgggtaggtgccatgaagacagataagagttatatgatacagtccctgccttcaccaaattataagctgggtaggaagctattgagcaatgtgaaataattaggagatgatacccagtgtgtataattaagcacccgggtaccaggtgcagtatggatcaaaggtttgcagggaccattaatcaagtgaagctacaagtgttgggaacctttccttgaaagatggacaagaattaaagagtatggagatgaggcatctaagctgagtgaattccctttcctctgcactcccagagctttgagttgagccagggtgccgctctggcctgttgattggcagctcagctaatcatccctggttttccaggcctatcgctggatgattgactccagagatgacttcacagaggagcgcctggccaagctgcaggacccattctctctataccgctgccacaccatcatgaactgcacaaggacctgtcctaaggtacgtggggctggtgaccctcagctctgcctcagagctgacacgccagaagtagcatgtgctcacaaagaggtgattggcagagagcaaccctagtcatttgagaaggaaagggaccagcatatgcctgtcctttcagtgtgagcctaggggctagtttggctcttagttgcaaggagtagactgactcgggccacctcaggagcaggctttatttgtaggctacacagggacattgtgggagttaaggatgcacaggaacccatgagcaggtacctgcgttcaaccttcccaggaaacagaaagcgaaagccgttggaacgtgggcagctgtgaggacttcatttcttctccatctttctcgcgatgtcagctgctaatctgctctgctctctagcagcctgttctttccttcggctctgtggaggttttctctgactcaaagctctggctttcgttcctcttcctgctcgcatttgctgctgcttttggctcactctggcctggattttgcctcccagcacacttccagcttcagccacccgcctgcctcccagcacttctcagcacagtttcctgagagggtgtcgcattggcccagctcaccttctcatgcctgcacatcagaggccacagctggctacagaccggctgccctttggccaggttctgtctcagtctgttttgtggtactatcacagaatttcagactgggtaattttataaagaagtttatttgacgcacagctctagaggctggcgccagcatctaacaagaaccttcgtgctgtattaccccatggcaaaaggcagaagggcaagagaaagggagcccaagctcagccttttttttttttggagacagagtttcgctcttgttgcccaggctggagtgcaatggcacgatcgatctcagctcaccacaacctccgcctcccaggttcaagtgattctcctgcattcgcctcccgagtagctgggattacaggcaggcaccactcatgcctggctaattttgtatttttagtagagatagggtttctctatgttggtcaggctggtctcgaactcccgacctcaggtgatccacccaccttggcctcccaaagtgctgggattacaggcgtgagccaccgcgaccggcccctctcatctgttttttttaaaagacagggtctcactgtgttgcccaggctggggtgcagtggcgcaatcatagctcactgcagcctggaactgctggccttaagtgatcctcctacctcctgagtagctgggactacaggcacacaccaccacacctgactaatccaaactcatccttttatcaggaacttactcctatgataatggcaatccatttgtgagggcagagccttcataatctaatcacttcttaaaggtcccacctctcaatactgttgcattggggattaggttttcaacacatgagcttttggggacacattcaaaccatagcaggtgtcagccctggtccagtcagccttgcccagtgggcagggaagggctagggctgtgtggttcagaacacggctgccctccgagcaaagactgtgggtgatttcactcaaaagttgcagtgagtcagtgggcggcaaggtggaaaactgtagggtggccagttagccgtaaaaaaagatcacactgtgtgtttgaaaacatgaaatccaagctgtagaattcacttattttttgcctggaaaccctctgtgtttccagtggcctcgctgggggagcccacaggcttcagctccctattgcctgggcttccatctgggtcctgtccccaggactgtggtttaccatgattgtgcctgtgaatagctactgacctctgaggcaagttatgctataaaagtgcttggaacagtgcctggcacatagtaagcacccaataaatgtcaccttatgttattttttaaaaaaacatgagtactgggcttgtttgagacagagatagcatcttcagtggtggggcctggctgtgtgtttcttcagaagctctgcgagtgactctaaggtgcattcctggtcacaaacctgtgcatggaggggatgggtgcagcagacaactgagacagccaagaacaggttctctgtgccttgccctcccttctgtaaaacagggctggaagttgggactgagacatagacataggccgatcatgaaactggaagggacttgaaaaccatcaagtttaatccccttatacagatggggaaattgagccccaggtggggaggggagtgactcgccccagatcactgtcaggtcagtgggaaggtaggactagagttaggccgtctgcctccccatccagtgctctttcttcctgcatggattgggtatgtaccaaccttctaagtctaaacacccttactgaccctgtggggaccggaaatacacaggtagatccagattcagaaggatatacagtgaaaattctccctcccactccacccagccacctccctagaagtcagattcttgtgtgaacttcagaggtgttttatgctgcacacaaatgcatatgtgtcctcttctgtctttcttatatcacatttatctgtattttttcacccactatattttggagattatcccatgttggtatatgaagagtgtctttttgaccagcctggacaacatagtgagatcccatctctacaaacaaaattttttttaattagccaggtgtggtggcacgcacctgtagtttcagttacttgagaggctgaggccggaggatcacttgagccaggtgttccaggccacagtgaactatgatcacacttcagcctggatgacagagcaagaccctgtcaaaaaaatatatattttttctttctcttcttctctcaagatctcttttctttctttccttttcttctttctttccacaacacttttttaggggggtagacttatccttctaaaatgaggggaaccttcactaacgtcagatgagtacttgtctcattttaccaagtacttgcttggtaaaagcaagtacttggtaaagtacttcctactttctacttcaatgaagctggcattcagtgggtttaattattgtgcctcctgcaaagcagatgttaacagctgtaggggcaaactgcagctaataccaatggtattggccagttgaaatcatcatggttttacaaagggttaatagagagggtagtttcttccacatacttttgagagctggtatatgctgatttctgctgctgcctatttaataatgatgatgtaaaagatttagagatgtctggctgattttgacattggcctgtagtcctagaagagacactaccctgagtgtctttgagcagtcagagagtgcacctctgccctgggcctgtttacctgttagagtgagccacacaagaaggaattcaacgtggcagagctcttgccagagggagctgaccatcttcaaatgttaaaaaaggtagacagaagagagcccttagcccaacccctatggttttgagggacttgatttgcattcaccttgcttggacactgaaccagctgaggaaggagtttcacccaagattgtgggttttccctttcagtttcagttatcatttgttattgattcttttctcttttttcaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaagaa

SEQ ID NO: 9460 - DNA, 105 bp, Homo sapiens
tccgcctcccgggttcacgccattctcctgcctcagcctcccaagtagctgggcctacaggcgcccgccactatgcctggctaatttttttgtatttttagtaga

SEQ ID NO: 9461 - DNA, 3604 bp, Homo sapiens
ggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccattacagaga

SEQ ID NO: 9462 - DNA, 2536 bp, Homo sapiens
tttaaaaataagatttaatgctttattgctcttgatggcaaatcaaaatatgctttagaaataaagttaatttactggaaaataggagtttttgcaccaaaccataaaattgcatttcattacatcaagagaaccccctcattgtctacaatcatgcccgcttcctttcccctcagcgcccgggacacgtgaccgagatcataccctaaattcctgatccttttgcagtttccacatactgtggcttttagtacatcataaaaaagtgcttgtcctgtggcctcagctgggaggccctggcgctggggctaaggggcccaaggcaccatccaaaggctgggaggaaagaacccaaacccaggccctcctcctgccctccagcctttgacaggcaactcatttggcatgatctgttttggtgtgtttaaaacatacatttgcatgtgtctagtgtaaagcaacaagtttgaggaaataagtggaaggagagaggaagttccagttagatggttccactagtgtctactggtaattggcaaaactatgagtgttgctaatctgggctgagggcacctctgcctgtgcaggcagctgaccaggcttggagaatgagaaagggttcccaaggacaggatgccagcgggattctttgttgcaaactgcacacagtgcaatttttgggaagcagggatggggagtgggcatgagaccgggttgttgggaccactctggggtcaggccctgggtgaggcacaggaggctgcacacaggcacttggtgggttctgccgggtcagggtgggaaggcaggagaagtgtctgtggcaggacgggaagaagcttcagtacatccctctcttgcacctctgcccactccacctgaggcgtgggctccctccccctcatcctctcaccacatgcctgaggcgtaggctcccctcatcctctcaccgcatggggcatttgctcccagcctctacttccctcaaggccttctcagcagctggggctcagtggggaaggtggtctcagaaggcccctgaagcatacgtgcttttgctgggcagaaactggcaagctggcagtgctccctggcaccagtttcacgggcgcaggccccaaggggccgtgtagagggcggggtgggcatcctggcctggcctgcagtgccaggaccccacgctgtgctgctgccccgcttcctgcttcccgtcatcccgtgtcttgaccccgcccttgctgtttctctgagtaggaaacgcagcgggaggtggtccagagggaaagcggccgaccctgagggctgccctcaccctggcagctccccgttctcattagggttcctgacccaagtgtggtgacagcaggtatctgattagcaaccctgcaaacggtgaaagtatctataagaggaccacagccacaggctgcgagttaagtaagatgatccttggagcatgccacactgtcctctccagagcggtggtcagaggccctggtgggggccttggtggcaaagggagtctcccaggggagaacctgggaaggatggactcactctgctggatgggctgttccgctcctgccactggctcctggctgaggggctggccctgtgggtgactctgctcacccagtggctttggctggcggctgggagttgggttggggtgggtccgccgaactctgagcagagcctccctgagctgggtccccagggctggctcaccttgggcaagagaggtggctatggggctcccgcagagtggggtcctgcatccccaccccttccctctgcagggtcagcagcagggaggacacctgtccaggtgctctgacttgacctggccacggggcatccgcaccaactaaaggcaccatccagttgcctctggggtgagattggtctggacgtcagcccaggggtctgggcggggcaccagggtctttggcttattgaacagggaccgtggacagtaaggacagaggaagatgataccaaaggcagaaaaccaggaaggaaatcttacaggggcggggctcctctgggaggggccctcgcagcaggtttctagcgggcatgggttgggaggcagcagctggactgggacccaggactcggagtgtggccgggctccgggccaggcctccgcggggcgtcagttcccgggcacgctgaggatgaagcccgagcgattcttggtgaagtcgggctggggctggttgagccgcgtctccacggagacggtgcacttcttcccgtgcaggctgcactgtactgggttggtgacgttcacttgaaggtggcgcttctcactgcaggaaccaaaaacaccagacgggcagttagcaggcagcatgagaacagggcacctgcccggcagctcccggccaccattggctccggcgcagcctgcttcctccacaagtgccaggaggatgcctgaagggccccagagaggccgaggcaaggcgagtgtggcactagctgggcctccaaccacagcctcggcaccatggcagggcccttggctccc

SEQ ID NO: 9463 - DNA, 2612 bp, Homo sapiens
ggactgcattttttatggttttgtttcaaaagccattttcttctgggaaaactattaccaaacaccaggtaagatttttgcagaatcttttattcctagcagcttctcgtttagtgggccaggaggcaatgcttattttttataatgggtacttaatgaatgatttaagtatgccacagaacaattttagagttaacttgctcttgtcttttcagaatggagactttaaatcataaagtactaagatcatggaatgtttttaaaaaaaacaagagggtaaaaaaaattataaagcattcatgtaattgttttcttcagtacacacttcttattctgaaagatttacaaattggacatgaaagcatgcccaagagcctagtacaaatgtcactggaaagctgacaaagcataggggttaagagtgtgatttctggagtcagacaaagtcatgttctgtctgtcctccttactgacccttactttgggcaagttacttgatttctctctaccttaatttgctcactgtaaaatggagataacagtaacttcctaacagaactgtgaggaaaaatgaattaatacttatgaagttcttagaatgatgcctcatcatcattgtgacaatgtgacaccctcatgatcattgtcactgttctctttaggcagctgtgattcaaactagaaatgtcctacattttgcataatcatctcacatcatcacttctttgggcagcagttataccatagtacatgtttgctttatgccatgacttacaaacctgcgtcataatttttttattagaaagacgaatttaagtacttctgtttcagagaccaagaacattttttaaaatatgattaatagtctaaaccccattttaacttttttctctcctttcagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaatgtgtgtttgtatttcttcattttgaatattatttttgttccactgtgttttacgtcaaatatttatctgtacaaatgtgtctagcacttttatagcatcagagagaattcaacagatagaacaaacctgtttagtttctggactagttctttagtgaataccattaatatatttattcatgatttgtcatagatattttactagttagaattccaagtttcagaaaatttttagcataaacggctttttaatcatttattcatgatccctgttaacagcttagaagctataataaaaggtctgaagtggtaaataaaattagccaataagaaggagaacaaaaatctctaaaagcactcattttttgcacaattttgcaaatactctcataaataaatgtctcagaagtagtatatcaattatcagattaaatgcgtggtggataaagtaaactactcccatttcatatttccctagatctatatagattagtctttttctgcaagtggactggtttaaggaggaaatgcttagggaccattgataggaattgtatcatgcagctgtgtatgagcattcttttaacatttccccatctgtaaaggattttacttagtgaataagtgtaagaaaaaatgccttgccgtgagaatgagaggtaaggagtgaaatgaagaatgttcttggccagcactgtggctcacgcctgtaatgctagcactttgggaggccaaggggtggatcatttgaagttacgagttggagaccaccctagccaacatagcaaaaccccgcctttattaaaaaatatacaaaaattagccagaaatcacttgaactcaggaggcgaaggttgcagtgagccgagatcacgccactgcactgcaggctgggcaacagagcgagactccgtctcaaaaaaaaaaaagaa

SEQ ID NO: 9464 - DNA, 2614 bp, Homo sapiens
ggactgcattttttatggttttgtttcaaaagccattttcttctgggaaaactattaccaaacaccaggtaagatttttgcagaatcttttattcctagcagcttctcgtttagtgggccaggaggcaatgcttattcttctttataatgggtacttaatgaatgatttaagtatgccacagaacaattttagagttaacttgctcttgtcttttcagaatggagactttaaatcataaagtactaagatcatggaatgtttttaaaaaaaacaagagggtaaaaaaaattataaagcattcatgtaattgttttcttcagtacacacttcttattctgaaagatttacaaattggacatgaaagcatgcccaagagcctagtacaaatgtcactggaaagctgacaaagcataggggttaagagtgtgatttctggagtcagacaaagtcatgttctgtctgtcctccttactgacccttactttgggcaagttacttgatttctctctaccttaatttgctcactgtaaaatggagataacagtaacttcctaacagaactgtgaggaaaaatgaattaatacttatgaagttcttagaatgatgcctcatcatcattgtgacaatgtgacaccctcatgatcattgtcactgttctctttaggcagctgtgattcaaactagaaatgtcctacattttgcataatcatctcacatcgtcacttctttgggcagcagttataccatagtacatgtttgctttatgccatgacttacaaacctgcgtcataatttttttattagaaagacgaatttaagtacttctgtttcagagaccaagaacattttttaaaatatgattaatagtctaaaccccattttaacttttttctctcctttcagataattggatcactaaaaattcctggtagaaaagaattcaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaatgtgtgtttgtatttcttcattttgaatattatttttgttccactgtgttttacgtcaaatatttatctgtacaaatgtgtctagcacttttatagcatcagagagaattcaacagatagaacaaacctgtttagtttctggactagttctttagtgaataccattaatatatttattcatgatttgtcatagatattttactagttagaattccaagtttcagaaaatttttagcataaacggctttttaatcatttattcatgatccctgttaacagcttagaagctataataaaaggtctgaagtggtaaataaaattagccaataagaaggagaacaaaaatctctaaaagcactcattttttgcacaattttgcaaatactctcataaataaatgtctcagaagtagtatatcaattatcagattaaatgcgtggtggataaagtaaactactcccatttcatatttccctagatctatatagattagtctttttctgcaagtggactggtttaaggaggaaatgcttagggaccattgataggaattgtatcatgcagctgtgtatgagcattcttttaacatttccccatctgtaaaggattttacttagtgaataagtgtaagaaaaaatgccttgccgtgagaatgagaggtaaggagtgaaatgaagaatgttcttggccagcactgtggctcacgcctgtaatgctagcactttgggaggccaaggggtggatcatttgaagttacgagttggagaccaccctagccaacatagcaaaaccccgcctttattaaaaaatatacaaaaattagccagaaatcacttgaactcaggaggcgaaggttgcagtgagccgagatcacgccactgcactgcaggctgggcaacagagcgagactccgtctcaaaaaaaaaaagaa

SEQ ID NO: 9465 - DNA, 137 bp, Homo sapiens
ctgtaatccctgctactcaggaggctgaggcaggagaattgcttgaacccgggaggcagaggttgcagtgagccaagatcgtgccactgcactccagcctggtgacagagcaagactccatctcaaaaaaaaaaaaa

SEQ ID NO: 9466 - DNA, 137 bp, Homo sapiens; identical to SEQ ID NO: 9465

SEQ ID NO: 9467 - DNA, 1047 bp, Homo sapiens
aggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctcac

SEQ ID NO: 9468 - DNA, 294 bp, Homo sapiens
gggcgcggtggctcacgcctgtaatcccagcacattgggaggccgaggcgggcggatcatgaggtcaggagatcaagaccatcctggctaacacggtgaaaccccatctctactaaaaaaaatacaaaaaatttgctgggcatggtggcgagcacctgtagtcccagctactcgggaggctgaggcaggagaatggcatgaacccggcaggcggagcttgcagtgagctgagatcgcgccactgcactccagcctggggaacaaagcaagactccgtctcaaaacaaaacaaaa

SEQ ID NO: 9469 - DNA, 247 bp, Homo sapiens; identical to SEQ ID NO: 7113

SEQ ID NO: 9470 - DNA, 686 bp, Homo sapiens; identical to SEQ ID NO: 7114
  misc_feature (95)..(95): n equals a,t,g, or c

SEQ ID NO: 9471 - DNA, 4293 bp, Homo sapiens
tcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggtgagaagaacggagcatccacctggtatggtcgacgggggagaggcctagatcctagagcttaagggatccttggagacaagaaagcagagagctaagagggaacaagatatgcttgaggaccagtggtagtactgatccttgggctcttgatcccaaaccattgctccttcctcaacccttgggtgagagttgggttcttggccaggacccaggtaaatgtgagtttcctgtgacaaaccatttcatcttctcatcctcacccaacctgatgatgaagacaagcaaatgtgaccattcatcacttggtctttgagtcacgtaacagacacgaagcatccttagagttccatatacatgacaaagcatgctgctaagatgcagctagttattccaccctttactaaaagattaatagatgcatccatcattactaaaagagtggcgactttgagactgtgtttaatcacgaactccttcattcatccaactgatacgtattgagctcctacttcaaagtatgaatcttctacagaattctagtaggtgaaaccaaggatcagcacacattttctgtaaaggaccagatagtaagtgttttgagcttcatgggacctacaggtctccttttcaactacttaactctgctattgtagttcagtcttacagtctttaaacaaatgggtgtggctgtttcaataaaactttgtgtacaaaaacatgaaatggaccagacatgcttcaatttttcagcccctgtgttaaacaaacaaaagcaaaactgctctggttaaattagaagaaggattcctcggtccctccagcctttttttttttttcttttcttttcttttgtatgctcttctccaagatctctcctcctggtgcacagtgcaaatatttttcaacaagagcacctccaattcagaaaaagctaaggttggatactgagcgctggccgttcatgagaatcaccaggagaactttccttccaatagttccaatatgtttgagaacagccccaggtgattgagaggcgttagggttgagaacactgatgtagataggttatagaatcatgtccatatttaacaacagaaagcagggctgtcagtatccatattttttataatactttgaatgagcagagtgccactcacagacaacagtgttcagtcagcctcagcttctgcttaaaaggaatgtcatgttcatgtgtccagcagtgctgtgagatgaactagttcaaagaaagttaatttttctagccatgagacctgggctttgtttgttttggacagttttgacagaattcttgaaaatacgttgcatattttcttttttttctttgcgaatagcatgtcccagacatactcttaaccttttccagtaccttaaggaaataatgagtgcacacctgccaggtattaacacccacacccatggggctagtgcggttggtggggttctttgtccctccattaaatgtcccagacagttcagctctgggagatcttgcattttcttttgatggtttttctcactcattcctcaccagcaactgtcttttcttgctgctgttgtattgttctacctaaaacagccgcctttccccatcccagttatccctgagtttattcttatctgctctgagctgggaaactagataacaaaagcttgtcagacaatatgtccaaaatgagagtaaatagatctgagtaaaagtgtgctgagttctcctctaagcgatatgacctaaatctgggtcacctgttttggctattcagaggccttttatttttggcctgagtattaagctgtattctgccaagttgagaatactgggtgacagtgtgacctgcgataaagatgtgtcagggagaggtttgttcttggtgagcttaggtccagcaaaatacttgtttttatttcatctggtctctcattcctgttttgtaccctcttttgcactcatctgttgagactgtcagatcgcatcaagtcctatgaggaatcataaacagatgtcagttaatcgagcaagagaatatcccatggcgtgtgtcatcctagactgtccatgtgggtgtgagctcacatctatttatcaagaaaccttttctaggccatgagctcggctcagcactgtttatacagtattggcttctccgtcatggtcatcattcaagaatattattactttcaccttatagatgagaacatgaaggctcagagaagccagtttcctggtccaaggtcatggaaacagccctgaattaccccactccaaagctgttgtgctgtcctttgccatctgcttgtgggtgccattatcaagtcattcattcactagccattcaatcattcgcttgggccttcatcatgcatgaccctcggctcttgcgggttctcacgctgctcttgtcttcttccaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttcttccccattcccctcccactcttgcaggaagctactgagacacaccttgacatagagagctaaattgcagtggataaacagcaacttcacactttctgttcccccattctattttt

SEQ ID NO: 9472 - DNA, 109 bp, Homo sapiens
ggaggctgaggcaggagaatcgcttgaaccggggaggcagaggttgcagtgagccaagatcgtgccactgcactccagcctggagacagagcgagactccatcccaaaa

SEQ ID NO: 9473 - DNA, 3902 bp, Homo sapiens
ctgatgtctcccggaggaatctgcaattgcataatttagttggttgcttgtctactgtctctctctttggcaagaatgaaagctctatgagcaaacagaccttgtctgccttatgatccattttattactagagcctaggactgttaaattcattaataaagtctttccatcactttttgttctttatattcctttactcaattgatattcagcatgtgcagaacagttcttttccaaggctgcataaaagttttggaatgaggcacataaataatatccttctaccaataaatgctatctgttataaaatagtttttattttataatcactgaatatgtcaaaactttacagttcaggccttttgaatcaaatgcaaaatcaaatatgaaaaggttaatgatcttgtccactaaaattgtagtttgccatacaggaaaatagactcttaaaaatgataaataaaaaaaaatcattcttaaggaaacatattaataagacatttaaaaaggctaagatctttaatgtgaaaaataataagataaagatgacaaccactgaagagaagaaaaaacgttttatgttttttctaaatgtgtgtaaaaacaaaatcttgtacctaccaaaatgacacttttttcaaagaaaggtatcaaatgtgtatactttaacacacagcccttccttgtgtaaatatataggaaatccttaaaggagcataaaacaatttacttagaaattctatacttaaacttattcaaaggaaataattaaaggtgtgtagataagatatgcatagcattgctctaaatgtcaaatagtagggaactaggtaaataagatatatctatttagggaattagtcaagtaagatatacctatttagctaattccatgtagccatcaaaaggataccatagaacagaacttattgatgtgaaaagatgattaaaatgtacttgttactaaaaacagcaggctgcaatactgtattaaataatgagcccatgctgtatatctagacaaacatatatcataatgataataataaatgtatgagacttatatttttgcttctctgtattttctaatttgtctgtgataaacaaatattattaatgtaatgaagaataagctaaaatatacaaaaacaataacaactataaaaagaaccccttcaatcaaaaagagatcatcagggatttaattcaactatggattggcactattaggaggccaaatatgattcgttgaactgaactgtagtaaagacaagatattaggaaaatgtttaaattatgtgagaactattctcaagcactttaaagatctatttgcaagataacaatgtgctaactttaagtaatgtctatgtattcttgagaccagctttgacaatgacagctgtcattccatttgacttgtacttacattatgttttgtctatattttcaaaaacagaacccagggactgattcttacaagcattttcttaaagattcactgggtgtctgtaaatctgatcaagctgttctttgggagatcattattcaacacttatcacatactttatttctacagctatgactgtcactccccaagcttcacttcataatgaaaataaagaatacagcccttttggaaaagttggatggtaataccaagtgcgtaagtttttagtacatgccatatcacaacctcctacgtggctgacttttgactttttcatttcttttataactgacagaagacacaaaggcaaaaatgtcaacttcacaaaaaatcttagtgctttttggaaagaatgttatagatcatccagtctaaccccctgatgttataaatatggaaatttaggcctagaaaataggtaagtgatgaatcaaactagaagcaggtgtcctgcctctaagcccaatccagttgccatcatcatttactatttacatggaacatcaggttctactttagaagttaactatcaacctacagggttaaggaaaatagcaatgtgtatatacagaccttgcatctggtagctgtatggtgcctgtccaggttgaggggtactgaagcttgtgccatagctgagaaatcctgtctgtccaggtgactgagactgtgacaatccaccttcagtcttgatgcctgcccacaatgcacctaaatcagttagtgatagcttatctatctgtccattttcaaaagctggtaaatatacaaaaacatacacttccacaaccgtttaactacaaatgcttccccaatcttatctcaaaaataaagggtatacatgcattcagtgaaataccataaagtacaacttcagttttttaaatccaggattacagatttgaatgtctattcacattattctctcttgttttattgcacttcaagacatatcccttctataaaatgtaactccagtgatatattttcatacttaattttgttgttttaattatgtaagagttgaagatcatctccttcacagtaaagaaatagccataattaaattttagctaaatgttcccaaagttgctatattgactagtgttaaaaataaaatccttttttatattaaaaatattaattagatcctataccatcacagtatttttccctcctttactctttctactacaaagctgatttcagtaccaactcattttgaagtccaaagaagcaatactgggcacagaactaaacaacatggtggaaaggcttttcctgaatatctaggtcctatcagaaaataagcacaaaggaagcagaacactaatgagctgaatcttataaaacagcagtgatttataaacaagtgaggttgaccagcagtttccttttgtccctgttagtgtgaaatatttgactataattgttttcgatgtagtctaaagtacctttgtttttatcatatgataatataaaaatgatgtatctgtggcccccaaatacttccccaaacaccaggctaacatcgtaattttgggacttggatttggcagcactgaggtatggggctcagctctgtctttaattaattacaattaaagacagtcatacatgttaacaactctccttcattctcacagagggagggaagaaaaatttctgccgagggaattcacattttttaataattttgcttcgtacttaagataaatgatatctttaggatctagaatacacagtagtcttactgtttatttccattttaggggaatctcatcagcagagtacagctaggtaattgttttaaggcagtgggagaatctgactcttggctgagagtgcctactttaattcctgcagtatctctaaataacttcataatgaccttaacatttaagtcttaacacaaccttaacattttaaaaatgtgattttccctgtaaaggtgatcccaaaccaatgaataacccacacatagaaatggtccctggaaatacacctgccccagacaggtggcatgatggctttagaaaatccctttctttccatgttgtcacccctagggattttccacctcttgctgcatttgagactatactgatctgcttccagccttcacctataccaataaaataccaataattcatgtattttttttttttttgagacggagtctcgctctgtcacccaggctcgagtgcagtggcgcaatctcagctcactgcaagctccacctcccaggttcatgccattctcctgcctcagcctcccaagtagctgggactacaggcacccgccaccacgcctggctaattttttgtatttttagtagagacggcgtttcaccgtgttagccaggatggtctagatctcctgacctcatgatccgcccgcctcagcctcccaaagtgctgggattacaggtgtgagccactgcgcctggcc

SEQ ID NO: 9474 - DNA, 12513 bp, Homo sapiens
ggcagctgttgaagacagagctggggtccttcttcacggagtacctgcaggtaggtgggtcttgctccagccaggctgggcctgcctcatgagccagccagaaagcacaggggctcacctgcccccgggggtgtggagcgccggctcccccactgtctgcctgcagttccaaggacctgcctcgttccttatctagccacgtggaatgttgtggaggttaaatgataagatgaggtgaattcttttttgagatagtctcactctgtcatccaggctggagtgcaatggcgtgatcccagctcaccgcaacctccacctcctggcttcaagtgattctcacaccttagcctcctgattagctgggattacaggtgcccaccatcacgcctggctaatttttgttttttgtcttttgttttgttgttgttgttgttgttgttgagatggagtcttgctctgttgtccaggctggagtgcagtggcgcgatctcagctcactgcaacctctgcctcccgggttcaagcgattcccctgtttcagcctccccaggagctgggattacaggtacccaccatcttgcccagctaatttttgtatttttgtagagacaggatttcaccatgttggccaggctggtctcaaactcctgacctcgaggtgatctgcccgcctcagcctcccaaagtgctgggattacaggcgtgagccaccgcgcccgaccaattctgtacatttcatattggtggcataacacggcctgcggacttttgtctggactctttctcttagcatcaggttctttctcattggagcacaagccagtgcttcatttctttgtgtggagatgggctgcattttgtggtccatgctttcattggcgggtgcttgggttgctgagaccacacagcgtggttcttggccgagccaccccaggcagtgcgtccagggtccctgaggtaggatggcagctgacgggcccggcctttggtaatcagagtcacctcttgatgcaaagtcctttcttcactgtgggacatgccaggcttctgcctgcccagctgagcccagtgcaaggagctctaggccctgcccacctctcgggatgtccgtgtgaccacctcctgtctcgtgacaacccggggttgggtcagttaccctcctggatgaactgatgctcaggccctgcagcaggtggactgtgggacctcagtgagtctcctccccctttaagccttggctgctcactggtggatggactctcgggggccctgctggccaggacacccccgggcatccacaagggcggtgacagcccctctgtgtttaccttcagaaccagctgctgacaaaaggcatggtgatccttcgggacaagattcgcttctatgagggtgagtgtgggccccttggcggccactctgggccatgctgggtcctggctggctgctggactgctgggcctcgtgctgggggcctctgggtgcaaggtgtggctctctggtccggagggcttggaaggaacacgtatagccttagggcagcagggccgagatccttacccagagggaaccctgggagagggtctgccccccgaacttgctggagcccaggagggctatgagacatcggggaaaagccccctgcttcccctccctgcccacgggactttctggccctagtgagctctgtccccgcagcctgggagagcccctgtcctggtctttgggggtcagaggagaagtcggttagggctgaggtcaccgatactcacagaggaggggacagggtgggggactcagctgaattttctctgtcgaggctcacagccacccactgggaccttcaggttattgttcctgagtgggagagtacagtgatgataagtgatttgcccaaggctacagtgcacatcaggggtgggggcgggactcaaacccaggtctgcctgactttagggcacacaccctttgcccttctcacggcccggaggtccccgctggcctcactgtgcaggttgggcttcccgtggccgagagcctcgggcagcagcagcagcgtgcgcatccttgcaggagcgagctgccctgggagcggggtcaggtgagggggtccactcagttcccacggatgctgctttgctcgggctgtgctgggatcgggcctgcgctgtacccgtgtgttgagcacctgtgcactaggcaccgggtgtgtgcgtccctccgtgctggactgccccgagtgtttcacatctactaactcatttgatttccacaaccctgtgaagaagccaccgttgttagcactgaatgaatggggaaagtgaggcacggtgtcctgcccaggccacacagctgcaccgtggcaaggccagggtgccaagcaggccaccgggtcccgaacccatactcttcactctgctgccccaggctcctcctccaggtctccctctgaccctgggaaaaagagctactagcccactccacagagaaggacacaggcccggaggcctggcatgttccaggggaccttggagctgcgtgtcatggtccttcctcacgtccactgaacatgttgggtggggccagccaagacaggaacacaaagagaggccatgaaaaccatcagaccgtcggggagacatgggggttctgggaaggcttcctggaggaggcaacatctagactggcaggacagagctgtgagcatttggcacctgacgaagatggccacccacgcccctcgcttgatgcggcacattctggcggtgcctgtacctcccaccagatctggcctaggggagccggggctctcggagaagggagttttgtgtggcttgaaaggagctctgcgtgggacagccaggtctgccaggcctcccagcaggggtgcctgcccagcagaaggggcagaggacagccctgggaggcccagcatcctcttctgcctcgccagcccttcctggcctccccaggtctcagggacaggcactgggctctacgctgggagtctgaggccctggcctccagttcccatgtagctgcagacacagggtttcctctccagcctcagcacccctgtcttagcaatgtggggttgaacaggctctgtccacttgagtgttctctacatgtcaggcccaggtgacctctgggagcccagagatggaggagaacctggccctgcccttcagggactcacagcccaattggggacacagacacggacccgagggtgacagttgagtgtgattaatgtcattgtgaaggagtgtcctggggaagaaagggttcattccaccttggcagtcagagagggctgcatggaggcagtggcccttgagtagggcctcaaagtgtggtctgttcaggggaacttgtggtcccttttggccccatgcagtggggacatagccacctccacatcctgatgggcggcctcaggggcctcccccttcctgctccctacccctgcttgggttccactgggagctcttcactttgagcctgctccttgcagctgtccctacagagcctctaccagaggtgggtgatggccccctgtggggaagccccaggaccttgccccctgccccttctcagcctccagggaggccttggacttcagcccctgggcagagccggtcctggaagcggagagcctggaggagtggccttgaggtggagggctgcctccctaggaaggggaggaagactggaccgcggccggggttgtagtttgatggcctgtgtgtggcttaagggaatcggctccagctgcagccaagcaactccttggaagccagaaacttgggaactctgggcgggagctcctggtcctctgctgggccctgggatctgccgtcgctcatccaccagggaatccaaacccggtatgggtcacgtgacccagctgtgctgccttacacgcttgcctccatgcctgtgcctcggccgtccccgcgccagacacccttgacctggtccacccagcgcgtggcttttgtcactgccctgcgctcctcactgttcctgagtctcccgacgggctgaaacagggttgttggtttgcagggcctgcacagggccctcagcactcggataaagaaaggaaagacggacaccagcctgcgcccacagcgagaaccccagagtgggagccagcacggagccaaggctactgcggggccgctcgcctgcatcagcccctgctactgccaggctggagccaaggtacggcgcgcacacacccggccccgtcctgccggcagcaaacgcccagtgctgtttcatctcagctttcgacctgcccacgtggggacgtgtatcacgcccctttcatagaggatgccactgagtccgcctggaggaacttcctggggtcgccccatacctgcctccgactaaccctactgccccacagaggggcccccacaggacaggccccggcagagagccccaacagccgcgaggctgcccttcctggcctctcgtcaccgtgtggctccagctggggcctggattctgttttacaacatctgctttccgcagcatttccgccccgtgggctggagaacagcctgcgctgagcagaacgcaggcctggccggtgcccagagccaccccccggccagcccgggaactgagctgcctttcttcctgccgcggcggagggggactgaagggactttgtgtgtgggcacagttcggcggggcggtgagcatccatccgtccggggcattcctgctggcccccatcaccctcagagccaggtttgggctacccgggtgggcagagggctggccactgggctgggagccaaagatgggacccagtccagctcggccccagcccccagggctgcccctggcggggtcccactcctagtgccctcgaacctacatgaagctgggggcttccgggagtgggggcagggcccagagagtgagaaaaaggcaaaggtccctgttcagcctccgcattcccatggaaacctcaaagcagttctggccgggggcgcagcctgagagacagccggcaacgcttccctcttcactcagaggcgcccacaccaagatctctctcgccagttgttcgtctggcttccaggggacagcagaggccttggggacacgtccttggactgtgcatccctggacccagcagccctcatcccagctccgctcagtccaggcagaaaggccaagggttcttcacgttgcctctcccactggaacccagagccagcttgggcagctgtccccgtcccacaagggtcactcacctggtgcatggcaccgttcctctcaaggccagcagaaatcctacagagctggtcccgatgtctgctacctacgtatctgtttcagagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggctactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcaggtgggcagcccagccctggggagggaagcccagtgcccctgctgtgcccaccctggcctcactctacagaggggggccgccaggcttggggacacacacacctgctctgctctgtgctgctctccttgggctacctgagttgctcagagcctgtttccaccccttcaagctgcagatatggacgcctccctccctgtgaatcccccagcagcgaggcacagcgtaggggctctgtgacagtaaccctttcactgccagaggaaactgaaggggccctctatccttgggacggggtcatctgaggagaacggggtggaggggcctgagggtcggcaggtctcttccccctgtggggtcccaggaccgggagaggggagatgaggacgcatgtgaccacagccggtggggtggggtgccttccgtccacagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcaggtgggcacagtgggcagagggtcgggcatggggaccgtggggcagtaattgggctcaggtccccacaggcagagcatgagatgaggatttaggggcacgagacttaaggaagggcccgatcagaggagaagcctgtcagggccagggaccggggagcagctggtcagagctgtgggtgcaggagagctcaagctgcagacccgttcctcttgggcacagggctgggcctttacaccctgtgtcggccagcctggggctgtgcccacccccagcacgcacacgcacatacacactacacacatacttgtgcacacgcacatagtatgcacgtgcacatgcatacacaccacacacgtgtgcacgcacacgctacacacatgcctgtgtgcacgcacatactacatgtgcacacgcatacacactacacgtgtgcacgcacatactacacacgtgcacacacgtgcacacgcacatactacacactgcacacacacaccacacacgtgcacacgcatacacactacacacgtgcgcacgcacatactacacacgtgtgcacacatacgcgtgcacacgcatacacactacacacatacatgtgcgcgcacacatactacacacgtgcacatgcacatacacactacacacatacttgcatgcacgcacacatacacacagtgtcccagtcatttctgcccagagggcttttgtcagtgggtcagctctggggaagacactctgagagctgttagcccccctcacagcaggtggggagaggtgcctgccccagaaaggagtggggcccccagtggcatccaccgcaagccaggggtttctgcacacggcccttcccaggcaccacactttgcagttggccggctcatcacactgtcgcaggaccacacagtcactgccggccaccccattttacaggtaggggacccaagtcctgcttgctatgagctaataagggcgggagcccagcttcaccccggctctcgcaggtgcaaagccctctttatcgttctgaatccccgtgaagctcttttaaaattagggtctgtgaggacactcgggaccctcacagggcaaccagagcaaggaaggggcggccagtgtggagctgtgcaaggtgggggctgccctgggtggaagttgagagagtttaggtcaggcctggctgggttgaagcggggacccttgagggactttgctgtgtcagcttcagcttcccggtctttaacagagggaggcctcctccctggcaggataggtgaggacttggtcattcacaaccaagtcactgctcctacaggcagacaattccagggacacgtggggtcccctgtgttagtgtaggtgaccttactgtgggcacctgtggagtcccacctactcattgtaacacaggccaggacataggagcctgtaccagccccgaaaccccaagagttcaggcgactttgctcacccccagggacgtggcctggaccgtgcctcactccctgcctggagtggcctcccacagccatcccaagagtcctgggttagtcctcgcctctggctggctggattgtcacttacaattgtacctgggtgtggccgggtgcagtcactcatgcctgcaatcccagtactttgggaggccaaggcaggcagatcacaaggtcaggagattgagaccatcctggccaacatggcgaaaccccgtctctactaaaaatacaaaaattagccgggcatggtgatgcatgcctgtagtcccagctactcgggaggctgaggcaggagaatcacttgaacctgggaggcggaggttgcagtgagccaagatcgcaccactgcactccagcctggtgacagagcgaaactctgtctcaaaaaaaaaaattctacccccgtgtatcttgtccctgaaccccctgacagccccttgaggcctgctgtcttccattcattcacttatttaatgagtgcaagcactcgttataagtcagctttctcccagccctctttgctgggtgctgaggtcccagagcttttgtcccagctcagcgcacagctgggtgagcagcctcatctcccgggccttggctcaaatacacctggaggtagcggtgagcccttcagagctccggatgaggggagatgatggcgtgagccagtgatgggaagaagagagtggggcttgtgaggtggtccctgatggatgtggactgcacctggccccatggggcagggagccccaggtgagcagcttggccctccctgcgtggggtcagccagtgtctctggagagactgtccaaagcctctaggactcttgagtacagggcccctccgaggggtggaaggtgcagaacacccatctcatctggccacagggcctttttccagggcacaccatggtctcccagatcccgacgctgctgtgagcagcagagtgactcaggccacatgctctgagaggggctgggaggccaccgtgggccctgccatggggacagagagcctgtgggaatggggaggcgggaggcagaggacaggctgtctggtgggtgggacatatggttgagagcctggagccaccaagctcgggtgcatgaccccctaccccctgccccactctcctgcagggggtacatgagtccaggggcgtgactgaggactacctgcgcctggagacgctggtccagaaggtggtgtcgccatacctgggcacctacggcctccactccagcgaggggcccttcacccattcctgcatcctgggtaggggtccgcctgggccttgggctggggcaggggtgaccacgggccccatccattgtgaacaaatgggcaagccgaggccccacgacagaaccaggatctgactccagactggttctcagccgggcagcagcccccagcctgccatatgctggcctggacgtggggatccgtgagagtgggcacacaccctgagcggtgatgtggcaacaccttggagagctccaccagacctccgtgttccccaggaggccacattcatgtgcagtcttgaaagtcagaagtgggccaggcggagtgctcggaacatgcaaatgccgaagcttgaggactcctggctcagttaggggacccaggctgggagggactcggcctgggggtgggcaggctgagccctgtgggcagcatcccgggactgcttggcgcgtccagcacagctggccacgttgctcccttgacggagggcctctgggttccttcagcaatgtcccttgagtacctgttgtgccccatcccgagcccacgcccttcccctcccgcgggggaggccgaccagtgagtctcctccacgacccaccattagctggaagctgggagcatcccaggcagaggggacagagctggggcaaggcccgcttgggactatgccctcctcatccagaggggctccccgtccccacctgctggtgtaaaacctgcccactggtgtgtctcagctcaggcagtgccctggctgctggagaactttgagccacccaggcttggtgtagccctggatggcaggaccccagcccctgcctgatgggacccgcatcctctggtctgggaaaggcccctgagccgctcgtgtgtgtcgcccgccacctggtggccactcttgggattgcagggtcctgcatgggaacctgaaccctgccccccaaccagccttggccacctgtgccactgcctcccgcccagatgaaccaaggggcctcctccctgggtccccacgtctaccctcagcccccacagtctattactctccacgcagcggccagcgaggcccatttacaactgcctggctacaggctccccgcatccccaggatggaatccccgccttgaccttacatggagggcctgtccccatctgctcccatcacagccccacaacctggccccatggctcgcctctttgggcttcttggccctcccaccatccccttggacaccagctccagtggggcaggggctgcgcctgcctgggaaagtacaggtgtccagcaggtgccaaagtccatacacttccacaagtggggaaactgaggcacgggggtgaggtaacttacctaaggtcaaacagaggtcgctggcggggtgcaggttcaaacccaggcatttgacttgaggtcctgtgtgaccaggctgggcctaggctggagaagagagactggaacctgagctggtgtcagggcttgtggcggtgggacctgctgagccgggccccgggtcgggccttccctgcagctgcccctgcacagggacccagtgtgcagtgagcagcaggtgccaaggcgggcggggacccaggtggcctctggtgtgacagtgcccgtgtctctccccagaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctggctcatgtctgcagtgcctgccctgggggcgccccttcagggtgctcaccctcaggccttcgctcccttctaggg

SEQ ID NO: 9475 - DNA, 104 bp, Homo sapiens
ccaacactttgggaggccaaggcgggtggatcacttgaggtcaggagttcgagaccagcctggccaacatggtgaaaccccgtctctactaaaaatacaaaaat

SEQ ID NO: 9476 - DNA, 869 bp, Homo sapiens
gctgagccgcagttttgtcatctgtgatacgggtgcataccaaccctgtggagctctctgaagctactcggaatgggtaatgtgccccaggcagggctcagctgggcaagtaggggagcaagagcagcctcgggacccaggcctgggggacaggtggtcgttgaacagaaagccagaacctggtctgagaaccactaagccaggctgatgaggccgagatccgtggaccaacctctttggctcccagctccatcatggagcccgaggtggcctgaggcggggagtagtgggtgaccattagcaacatgggcaggagggttcccagcggtcacctcaaggcaggaggaccaaagaccagaagccgtggcagggagttgctgtctgggctctgtccacaccagggtgctagaccctgtgttctgtcccctgagtggtgggggttccatcgtggggggtcgagcatccctggcccctggatgctgccgggcctggggtggcccagggactggtggcccctgctggctggcacttggacccttggcaaggcagtccctaagctctcagtcctcctgccctggggcaggaggggaggcccctgggcagcagccagcagcatccccaaccacagattggggggctgcagtccaggagggtgggtgctgggcctgggccctgcagcagctcacaggactcagtgggggccccaaggaggtgaggaggctgcactcccactcccagaaagcagcagcccaccaagagggtgtgtgtgtgtgtcctagccttgttcccaaagatgtcagaggtgatctgcattcagacatcttataaattggtaaacacctgtaatcccaacagagtctcgctctgtc

SEQ ID NO: 9477 - DNA, 22459 bp, Homo sapiens
cggggtttcgcagcgttcatgaacctttaattcattatgaacctagaggcagggacattaggcaaaaaatacagcgtatccttcatctcgggtggggaaaaaccagggcactgggttttgccgcgtctttgcacagagtaagacacagagataccttcgtggggagagtgtgcagctccggcctgcccttctgtggcccatctgcgcaggccgcccaggagcccaccaggggatgggtgtgacccccaagggacaagggcagcaggggcacccgcccgcttctttacaatataaatagcattttcaaacaacataagaatacagtgtcagcgccacgccgggcgagggctgcgtgcagagggacacctccacgttttggctgacaccccccaacctccccgaccccggccctctccagggcaaccgcccccctcccccaccaaggaaatgaaaggcttgctcctgcgtaacactctctctgttttccttagtcctctctagcccggggactgttaggacactcttttataatataaacattgcttttttttttttttggagacagggtctcgctctgttgcccaggctggagtgcagtggtgcaatctgagctgactgcagcctcaacctcctggactcaagcaatcctcccaccacagcctcccgagtagctgggaccacaggtgcgcaccaccacacctagctaatttgtaaaaaatttgtagtgatggggtcttgctatatagcccaggctggtcccaaactcctgcctcagccattttttgtttttaatataagcaaattatctcctccatccctccctggggcaggagacagctaaggtggggaaggctccccagaggggtgcagagctggtgagggagaggcacctggagaaggcgcttcccagcctgggctgaaggccgttttttctctatcagctcaacccactcctaagaagcagattcccctcaggtgacagcagcgtgggtgggtggagcgaggacaccaggcctcgtccctgcccggaagcaggcgaaaggggccccgaaggcctgcctcggccctgtgtcccccgacctgctcagggttgtacccgaagagctgggaagctgtccacactcactaccaaccagaagggcctgggggcctccctcatcctgagccataggaggtgcaggggtgctttgtctgcaaggaagcctctggaacacctgcgtttctctcaggtgagagaaacaaagatagacaaaccccaggagagagtttattctgcaaaggtgggcgcagacggagggaggccccagacccccgggcttcccctggccaggtgcacaggggcggccaccagagagcctgggcctcctcccagcaggcacagagtgggcacaggcactggcaccagaccatcaaagcccaggagccggggtgaggcgagagcgaggccgtgagtgaccgggctgtgccgaaaccggggcgtcctgccccccccccgaggctcaccctccaattaccgggtctctttccctgcctggtctgtagccaaatcataatattttaaaacaacaacaaaaaaacagcgagatgctctgacctctcagagaatcctggttctgagaaaaacaatgtgtttgttttgttttgtttttcttaaagccacaaatctagaaaacaactttggggatattttcctttgttttcctttttttcttgcttttttttaaacaatatgtatttatagaaagagcctcacaaaggtggtttatgtacagaagtgacaatctcaaaggttgctcagtagggcattgcagtagcaccttttcgagaagaagagagcttacatggtttaaaattctgagtagttgagtggggtgctcccctggccggcccccgagcccgcctggccctgctccctgagtctggggccgcgtgcggcgtcccgctggctcctgtcgccctagggggcacccgcggcttggaggtggcctctcgggggtcggggacacgaggacaggaattcacagcaagcgaacgcccggggcatgccatggcctccccgccgggctgagggtcgcctgagcggccagctgtcctagaagggggctccgggccggccctgcacctgcaggaggctctccacgaaggccacgtagtcctggctccgcccggagtcctccgtggcaagcggggtgcccacacgcgggcgcttggcggccttggcctcctcccccgagaaggcgggctcctgcggtgcccccgtgctcagtgactgcgggagagcggaagcacagtggttagcacggtggagacactctgtgcggccccagccactgtctatggcctctgagaggagctggctggacacagagccctgattgctgtgggggctgctcagcaggctcctgttttcgtgtttgtaaacccctgatcctgccagcagaggggccctgcactcggccccagcctctggccccctagtggggtgggcaccctggctggggctgggaccgtccatctggcagctcccatctgttttccgagggacccctctgcggctgagcagctgtggccaggaccaggaacctcccccacgggctctgcccctcaacacctcgcctctcgcctctcgattagaaagagaataaaggaagcccatgagggctgggggagcgaaagctggagctgcctccgctgcctccaggactcaggctcccgtttaataaggaaaaacctcaggaaaagcttttttaagccgacaactggggtgcccgtacttcgcctgtaccccaaaacctgtgatggttcagaggccgccctgtgcagggtggggcagcgcgggtcctgcagggcacagggggctgggagggtctgttctgcattcgtgataaggggaggggcggggcttctccaaccctccctccccacattaacggcatcgcccaggagctgcggcaccaggagtcaaggcaaaggaagggtctcctgccaggagcccatggaccagctgtgctggggcggccgggacccccttccagcagaggtgcaagaggagggggtggtccacgccattggaagacgcagtctgtgccctgcctcgtcccagacgggctccctgagtcacccggagccaccaggccagcctcgcgcactcaccagccgagagcggaccctcttgggcagctcctcctccagggtgaagatgtccccacgcttcaccgtcagctgggacccgtcctcaaactccacctgcagggggatgtggctctcaggggcctggcactgccaggatggcaggtgctccaggcaggccacggcctcaagagctgggaggccagcccccttgggtgcatggggcccgctagaggccacatgcagccaagctgaagctcatgtccacctctgacaccgcctgcagcaaacaaggatcaggctgagggtcccgtaccacggggcaaggatgacggaggacgggacagcctggggcagaggcagggccccgcagcttccacatggagacagaacactcacccctcacctcctcccagctcaaaagacatctgtctccatgaagacacagccccaggacaaggtgacagagtcactggtggacacagagccaggcaggaggcgcagtgccctaacagggcctgggaggcaggggaggccggacaggcggactcaggggcctgagctcaggagcccccaaccagaaggtgaaggacagggtccctggcttatgtgtggccctctgaaaacagctcagtcacctcttcccttcaactcagagaaaaatcacccccttccagcctccccagctggtgccttgttccaggtggcagatgcctgactggtgaggggcactgggagcaccccgcttcctcctcgttaagcttggtgccagctcaggctcgcggagactctctcaggggccctctggcaacacaacactgtcccatgaagggcgtgccagggaggggcgtgtctccaggcccacctcataactgcgatgggcgccgtgttcccaagccaggaaaggtgctggggtcactccctgggcctgactgccgttctgctccagggggagaaggttcccatatcagagggctcgcttttcacatttaaaaactcaaaacaagccaggcatggtggcatgtgcctgtggtcccagctacccaggaggctgaggtggaggctgtagtgagctctaattatgtcactgcactccaggctgggtgacagatcaagaccccgtctcaaaatgaacaaaatgcacacataagactgtcacagaagcgtacaaaagtcacacactaagaccatgacggaagtgtataaaagtcacacagtaagaccatcgcggaagtgtgtctggggctagacgccccacgtagtgtgcagcgggggggcccgggatcgcagcacctccctctccaagggagcacagaccctgccttggggcagccaagcctgccggtccctgtgactcctccagggatgggtggggatggagacagacgtaggccctggagcaagtgtctgctgtgggttccacatgcctcttggccggcgcaggcggcgggagaagcagggctgggagtgcccagtgtggactctcagatggccggttgcctctgggccgtgtcctgggacgacagcacacatctctcggggatgtgtggaggagcctgctgggaaccaaggacatgggtgccaccctctgccccgtcctacccatctcatttgtagaggaaagccaccgggagaaggccccttcccagcgtctgtccggtgaggagagtctgggtgaaggagtcctagtgtcggagccccagcaccccggaaagcgatttccacccccggcgtggccaggctccgctttgccacgggcagcagcgggttttggaggctccgctttgccaagggcagcagcgggttttggaggctccgctttgccacgggcagcagcgggttttagagctcccactgcaggagtcccagggcccacctgctgcctttccccagctccccggccccgactcggcctctcggcttctggcaggcgtggcacacagtgattcagtcaggcacagaagcagccttgccaggaggggaaggcgcgttctagaaactcagtggaaactggctcaggtttctgggtcaggaagactgcagagatccgccccagattctcaggagcacagaaccgcctaggaggatggcgctcacactgccgggtccaagtgggctccagggaaacttctgtgcctgggtcatttgggaactgggggctgactggagactcaggctgatttcctcccagtggcctccctggaacgtgctttcactatgagtctccacagggcgagttctgaaggcggcgtttgctttttaacattttgagaaaactggatatacttgcagctacaggaaatcagaggcgtgcgcctcggcccgggctccctgtggtgacgtcttgcccggcacgtctcagaagcatctcgaggggtcacgtgcgagggaaacatgttccaagtgttccggacaggcggggaggctcttggggccttggcatgtgggggtctcagccactcggcctcgctgtcacctgggcccaccccagccacccgccccgctgaccaggcccttggcctcggggcaggcagctccagccccatctccttggccaccacacagcgggcgtttgcatgattgtgtgatcgaggtcctgccgccacctcgcaggcaggcgcgcactccacggtggcttgctggcttccgataccacccattcctgattccacagcctctgcccccccgccccgagcactctggaaatgtgacttttttttttttttttttttgagacagggctttgtttcatcacccgggttggagtgcagtggcgcgatcttggatcactgaatcctcaacctcccaggctcaagtgatcctcccacctcagcttcccaagtagctgggactaaaggtgcgtgccaccatgcccagctaattttgtttttttgtagagacagggttttgctgcgttgcccaggctggtctcgaacccctgtgctcaagcgctctgcccacctcagcctcccacagtgctgcgatcacagcatgagcccccgcgcctggctggcatcatctcatttctgactgtctcattagctcggcttccttgaggtgagctcccctgacgctggccctgcctgggctctggtgacatgacaatgatcctgggagcacttccttcgccaccagggtgggggctgcgtcagcgcctcttctgtgggatgttgtcaagacccaccctgagtctcccttgtcattttccaccacagttgtgctctgtgtacgttataaatggctatttatctatttgtgtgttttctatcatctccataggtttcttgagggagggagagagactggcacatgctcagcctgatctctggagtaaacttccatggtgttctagaggtcctggctcaacctcccctcctcggagtccagtccgacctgcctgggccagactctgaggctcccggggcaggcggagggtgttgtcactgtcacacagaccccacccatcctgccgtgtactagatgcaccagaatgcttcccagcagagtttttgtttttttttttttttttttttttggagacagggtctcagtgtcacccaagctggagtacagtggctcaattacagctcactgcatcctcgacctcctgggttcaagcgatcctcccacctcagcatcccgagtagctgagactacacgcgcacactaccatgcccagctaatttttaaaattttttgtagagattgtggggggggggggggtctcactttgttgcccaggctggtctcgaactcttagcctcaagtgatcctcctgcctcggcctcccaaagtgctgggattacaggtgtgaaccaccgcgcccagcccacctgaaactcataacctgagagaagagctgccaggtgagctgagcagggattattctcttttgctgctgcctgggatgggctaaggggtgcaaatcgaccttgcccttggtctaagcctaacacaatcaggaagtccaaggagctgcctgagcctccccccagggaaggctggagctgagcagaagtgacagtgtctggagattggtggtagctcccacagggctggccatggggatggcttgtccccgaaaccacccccttctcaaggagcagggaagaccctgcaaggtccgagagtggtgaccgggtggggccagcctgcatggcaaggaggtcctggatgctcagtgacaggtcgagagtggtgactgggcggggccggcctgcacggcggagcggggggggtcctggatgctcagtgacaggtccgagagcagtgaccgggcggggccggcctgcatggcaaggcggtcctggatgctcagtgacaggttgagagtggtgactgggcggggtcggcctgcacggccgggggtgggggtcctggatgctcagtgacaggtccgagagtggtgaccgggcggggccggcctgcacggcggggggtaggggtggtcctgggcactcagtgacactcgatcatttcagttcattcaggtctggcgggagatgcgggcgggacctttccttaatgcggcctcgggaccatcgcaggggttagggttttcaccttaaccgacgtggtaaagagctgaactccgatgtttacaaagaacttggggctcggggtgcgagctaaggccaggacgtcaccgactgacccgccgcgtgacccgaggtgactctgagtgaggcttcgtttccactcctcaaatggggcagatgtgactggaagagacaagctgtcgcctcctcccgggagcctcgagccaggggagctcaagggaagtgcggcaccaggcttgggagcgacgcttctagctgctgggatatgggcagctctcctcctaaaattccacgcttttatttcatttaattaattaattaattttttgaggctgagtctcgctctgtcacccaggctggagtgtggagtgcagtggtgtgatctcggctcactgcaaactctgcctcccgggttcaagcgattctcctgcctcagcctcccgagcagctgggactacaggtgcctgtcactaagcccagctaatttttgtatttttagtagagacagggtttcaccatgttggccaggctggtcttgaactcctgacctcaagtgatccacctgcctcggcctcccaaaatgttgggattacaggggtgagccaccgtgcccggtctaagattccacacttttaaataattcctcttccacagtcatgagaagaaactcactaccaatttgattaaaaaaaaaaaaacccaggggtactgagctgtacactccaaaacggtgaaagggagaacttatgttaagaaaaattgagaaggtgtctcaaagggaaatgtcacccgagtggaggcccctttagctttgaaaacaaacaagccctgtgcttctaacttaggcaggcgagccaaggctcagctgggtcctgcgggcctcactaaccatggcccacacccgccagtgccccaggcaaaggcacctgggccaggggtgtgatcctcctgtccccgcacctacaagaagagcttggtgaaggcatggcgcggctgccagatcccccgcttacctggtagatgtggctggtgacggaggagatgaacttggccttgtagaggttgccgtcagtccaccggagctccaccagctccccctcggaagggggtcccagctggacacagtccctactctgcagggagaagaggtgggaggtgaggtcctggccacactacgctgggggctgtcgctgggttttagaccctctccgcgctggcaagtgaggttctctgcctgaagccccaaagctggctgcgggggcccggggtagcggggcggtgcagagccctggctgcgggtcgctttctgctgaacagtgagcggtgcttttcctgaaggggcctggggccctgaggacaaggggaccccatgaagggatctggagtcaggccactcctagcttccccccgcccacccccacagctcaccgtgatgctctcagggtacaggttgtcgctgtgctcccagcctccccccgccccctgccccaccccacagctcaccgtgatgctctcagggtacaggttgtcgctgtaggagccatcgtcgaagttcacttcgtagcaggtctgcgaggcggcaccgatgacgcgacagcggtagtacagcccgttgcggttcttggtgatgaccacctggcctagggacacggccctcaggagttggacctgggagggtgcggagggtgtggggggcggtcagcgcgggtgtcggtgggggcgggagccaggggctgggggcaaggaggcgggcaggcactcacagcgtgaccccccgacttgtgcttgaggcaggtgatggagaccacatagggccagtcgtccggctccatgagcacgcctgcggcgtgggcgcaggtcacgtggaaggacgtggagcagtgctcgtaggagcactggatacaggcacctgacaccttcttcatccgcttccggcagtacacgcatttctggggatggggacacaggcaggggcatggggctcgagcttccctagggaccctggaacggagtccccggcccctcccggcacagccttcaagggaggcatcgcgggagtggccctgcgctctgcccagtgagggttcccctccacagcccagagcccgcagcctccctggccaagccctccagacccactgacccagcctcctgctgctcagcctctggggagtcctctcccatcccccctgcatgtcactggctgctgggacagatcagcccccggggagtcctctcccgtccccctgcgtgtcactgactgctgggacagacactgaagagccccacgtggtgtcgctcagccagaggaaccacgtggcgacagagatgtgccctggggacacagaggtgagtgcagaccatgtgaccccgtgttctgcaacccccagggcaggccacccccagacacaggaagtgggctcgtgggcacagggtaggggatgggagcgactggtaatggggcccattcttcatggggtgatgaactgttctggaattagacggtgtgatagttggcacaactcagaatgtactaaaaaacatagagtggcacactttagaatggttagagtgaaggattttttctttttttttttgagcctgggtgctctgtcacccaggctggagcacacggcgcgatcatagctcactgcggtctccaactcctgggctcaagcaatcctcccacctcagcctcctgagtagctgggaccacaggtgcaaccatcatgcctggctaatttttgacttttgtagaggtggagtcttgctatattgtccaggctgctctcaaactcctgagctcaagggatcctcccgccttgacctcctaaagtgctgggattacaggcgtgagccatcgcgcaggtcctttacatcggcttttaataagaagccctgagagaagcctccttggtgaggagggagcaccggagagccacctttcatcccttgaggctcccgctgcaacacctgcccgagccagcaccggggccctggcggccgccacacccacgccaggcccagctaagcatttaataagcggcaccgtcaccactctataaaccacgttcaaaagccagataagccaagggcctggagcagggccgatcgacggcatcgagatctcgttattaaactgtaaatacccaattctcccatcacacaacacgcgccaggcatcactccagcacggcctccccctccggcagagtagccagtgtgtaggagtggaggctgtgctccctggggagcctgggggtgggggagaggccccacctggacactgtcaggtggggttgctgagccgtcttgaacacgtcacccacaggcctccacccctcggcccaggcccaggagaaacccagccccggggcaggctggtgcccagcaccatccccttccgcctcgtggtagcaggcagcccatgaccctgcatctccacgttgtgaaaagcgtgcccccggacccatgggaccatttgtcaggagctgtgcctggggccgaggttgcccagagccacccctactaaggcgaggtccagtcacgccacgcgctgtggccacaggaggtcgggcaggcgttcttggccgtcacctcccttcctgggagccgcagtttgaagacccacatccagtgctggcctggcccaggccagtgtgtgccggggagtcagggtctacggcccgtggggggcctggaagggcccaggcactggtgtttggttcgaagttcccggctcggtgtccttcctcggaggccacagggctgtgaggacgacgcgggtgggcttcagaggtctgcagagcaccacggcctggaggaagcaggtggtcaccgctaggtaccacccatgaagctgtgtcctcagcctgtcacacactgaggcgcagtggctgtccaccaacctgctttcgcaaacaaccccaacccctgaggagcagagagcccctccctcctgaccgagccctacccctccaggcaggactgtgggcagtggagagagctggtgcaactgcccacccctcctgctgccctggaggcgcctccccccatcccaagcccctcccagacctcccagatcctccagggagctcccggtgcttttgcctgctgccaggaacctgcccagccggtaggtgagaagcttctcagcagcacggccttgagaacgtggtgataacttggcccaggcgggcggccagccggagccccctgactcaccaggactgcctggagccctgagccggtggctggagaagtcctggagacaaactgacggatgggtaaccaggagtgagtgccccatgcctgcagcctgcccgtggcccgcgaaggtggctgggcggttgggcgagcaggaattaaccgccgcctccttgcaaagccccattaagcagtacaagcgggcctcgtgtaaaaggatttttaattcatcgttacaagcaccggtaatgaagaggctgcgttctggaaatgtcagatgatccataaggcgtcgggcaggaggacttatcactgcaccacgcatcgcaccatcactccacctgaatcatgaggccttttacgcccacgtttgtggactgagtcactggtgcctcggaagcatcacccgcgggctgccggcttcctaatcgcctggccgtgcccggccaggccggcgtgacccactgcacactccactccacgaacaaggaaagagggctccccttccagatgagcctctgtgactgcctgcacagccctgcccaggtggcccagcacctgtgggctccaagcatggcatccaagcccgccgggctcgtgggcacctcgcaccagtgcatgggagcccgggctttgtggccggcatcagtcccacccttgtggtctccccagcagacccaccctgccagactgatctgtctgcttccagccccacctccacgcaagcctgaatgtcaacaccaggcactgtgtccgcggctgggaagataaaccaggcaggaaaagcaggcaggacgctgctgggtgctactggctgcgggcccagcctccaggggcccacgagacacgtgtgcagaggccggagtgcacagggacaaatgcgtcctccccatcagcgctgccacatgcacagcccttagtggggacgcggccccagcaacatctgcattttgctctcctcatctttttttttttgagacagagtcttactctgtcgcccaggctggagtgcagtggcgcaatctcagctcactgcaacctccgccgcccaggttcaagcaattctcccgccttagtctcccgagtagctgggatcacaggcacgtcccgccatgcagagctaagttttgcattttcagtagagacggggtttcatatgttggccaggctggtctcgaactcctgacctcaggagatcgacccgcctcggcctcccaaagtgctgggattacaggcatgagccaccaggcctggcctcctcatcttctttctgggccaggtcccaaggctctgcaggaagctgatttaaagggccagctgagtgtcattttccagcaggcgtggacagccccaagtgccttgtgcgcaggtgggctacagggtgtgcagcagacagccctgcagggctgcagcccaggccatgatcggccaagcccctccaggccccaggctcctcacctgcagaacagacagtgcaggatgaccccacaggctctcactgtgtggatcaaatgcagtaggtgacactgggggcctgggggagcgaggctgcagatttgacaagccctgagcagctgctagtgctcagacagggtggtccatgctttagggagtgggcccagctcacaccactgcaaccctgcatggcggggactgtggcaaccccacagcacagaagggacggccgaggcacagagaggtcgaggaatctgtcccaagtgcacagccagctggtggccagcactgaccactcctgactgccctgtggctccaaggggttccccaaaggggggccatcattgctgagagcaggaggaagcttcacaagcccccacgatgaggccccgctacgcccaaggtggctgcgcgcatctacggggggcctcaatgtgcaccaagagtggagcagcagagatcctccaactcaaccacaaaaggccaagcaacccaggcacggaatgggcgaaggagcagaacagacgtttctccaaagacggcatgcagatggccaacaggactgtgcaaagatgcccagcgtcactgaccgccaggagaacacaaatcaaaccatagcgagaccacctcgcacctgctagggcggctgctacaaaaaagtcaaaggtaggtgtgagtgaggacgaggggaaggggaaagccctgcacccggggggtgcggatgggagtccgtccagccgcaagggagagcagtttcctccagtgctaaaaacagagctgcccgacggtccagcaagcccactgctgggtctgtatccacaggaaatgacatcagaatctccaaaccacaaccacactcccacatccgctgcggcgcaacccacaacagcctgaaggcagagacatcggcgggtgcccggatcaacacaacgtcgtccatccacatggtggcacatcactgagccaggaaaagaaggaactcctgccatatttgggttgaatgaatgtggatgaaccttgaggaaactatgccaaatgaaagacaccactcgcgcctgtaatcccagctacccaggaggccaaggcaggaagatctcaaggccaggagttccaaaccagcctgggcaacatagtgagaccccatcttttaaaaaaaaattgggagttaacctaactttttggcacgtgcttgtggtcccagctactcaggaggctgaggcgggatgatcgcttgagcccaggagtttgaggctgcagagagctgtgatcacaccactgcactccagcctgggtaacagagtgagagaccctgtctcttaagaaagaagccggtcgcagaagaataaagactgtacaatcccactcacgtggggtctataacacaggcaaacacacagaagcagagtgctgggtgctggggtgggcggagggagctgctgcttagcacgtgtgaagtgtcagttatacaggacgggtgagcgggccgcagagccctgctgcccaccactgggcccgtggtgaatgctgtactgaacctcagatgcttcttaagagggcagatctcacgctaagcattgttacaattgtttgtttttttttgagacagtgcctggctctgttgtctaggctgcagtgtaatggtgccatcacagctcactgcagcctgggtatcccgggctcaggcgatcctcccacctcagcctcccgagtagctgggaccacaggtgtgtgccaccacgcccagctagtgttttttattttttttatagagatggggtctcatcgtgttgcccaggcttgttataattattagaaaaacagcaaagatcagacagcccggttgtgtcggggcacgtgcggtgcctctgcttttgtgggaaggtggaaactgcatggggtgctcgattctgcagaggatgcccccaaggccacacctgacggggcctgcttatctctgccacccttgatgccttctgatttttgtaccttgcacctcggggaaggattcaaaaaataacacacctgctgaagtcgggatcactggcttcctgaaagctgcccaccacccccatggagacgcagagcttggaggaaagaccgcttcagatcgcgcaggtggggagccgagcatggccggcagccctagaggcacgggcagggtgggcctcgaccgcaaggacctaccagcttccaccgctgctcggggatggcgctgatgtccacagggtggcgctcaatcacgttcaggaagcgcgcctcggggactgcgatggcacagatcacgtggatccacctgggagggcaggtgcagcggggtcaggtgcgcctctgaggacctgggctggtcacagaggggctgggcgtgatgtggctgtcggctgggtcagggcctggggaacttcaggaaggtcggtgcaggcgtatgctcctcctcagccctggccaccccatccatgacacagggcggttatgtggaggtgatggtcaacccctaggcactggggtcacaccctgcagagcctcagcccagggcaggctcccctccggccctccagccccaacgcgcggtgccacccacctcctatcggtggtcatctgcagcgcacctcctcgcaggttgcacaggcagcactcctgtggagaccagacagccctggatgagcagggctcggagcaggctccccacacactgcttggggcctgatctgccaaccgtccccagcccacggcccttatatttcaacctagcagccaccaaagtgacgggtgggaatcccttgggttccaccccctcagggcagaggtgaaggaacccaggcccacggaggggagactacgccccaaagtcaccccactggagtggggccggggcccaggcctctcagagcaccacccccgctgcggggagcgagttaccgcagtccaggcgtgggccgcgcaccgggaacacgtccagccttcattgaccagctcgggacggatgccatagcaacctggaagacagcgggggctggctgagatctggggggcaggtgagacttggggagccgagtgaaactcagggggaggggccgggtaacttgggggccagtgtccgtatgtggagtgacgaggcctccgcacgcagctgcagcattcagggtgcgtgctgttcccaccctctgagcttcaatccaggccactgcatgtggagcgagagaaaggtctggaagctacttgtgtggaaagaggacgcaggaggggaagcagggaccctgagctccagctgggtctgccgcgctcagcctggtggtgtcttgagggcccctccttgttgggtgtctgcacccccaacagcagctcctcctgctatgtccagaaaggccaaagccgcaagggagactcactgtgggatgtggccctgggtctggaaatggggaaagggcacaaaaggccgaatcatgcccccagagcgagggcaggggtgccgcctgccccccagggctctgcctctgctggggatcactgcccccagtgtggaaggggctctctgccagtgctgatggcccactgaagaggctgggggcggggacctcactgcctccagagcagcagggtggtgggcacggctgggggtgggggcgtctgctggggtagcctggctggggcggcccggctgtggcaggcctgggaccctcggcaacccttcccccagggagcccatctgccccgggggcacatctcaaacccaggcccagcaaagcagagtgaagagcctcccagccaggagacaacgcgagcccccaggcaggccaccgccaggaggaaaccgacacagatctatggctgccaggggcacagaaaattaaacgtctccagagagccctcctccttccctgaaagtccaattcctgccaccgcccccccgtgcgtgggaaagagacagacatccattttcttgtctgtgaccatggtcgagcctcaggactggggaggggtccctgagagcagagataaatcagacgccctgaccacgctgcaatctcactgtgaccatcagtttcaaccacagccacaaatcacaggcgtagcggctgcctgagttcctcctgtcgcctcccaggccttggagaagactcggcagaactgtccagagggccagtgaggaggaaccctgcctgggccaaggtcaagggcagggatgtttgcccccaaaggctgcttggcagagacagccattctcagggaacacagcctgcggagagacggggtgcctggcccatttcttgctctggccctagggtgagcttctgggtgtcagggacagggtgggatgagcccagtgccccttggagcagaggcttcctccgcagaggctggcaccagaggccagcacctgggcctgcactggcatcttctggatgctgggggcggtggaggccctgtcctgccccagggtggcatgcggtcatccagcccttccatggccacagcctttccccctgctctagatggtgggaccacaacgggaaggatgagaaagtcagaaattgcaggaagtcaccgggggaggcccctgccctggccctgaaagtgcagcctggggagaggggccggtgtggccctccgcaggggaggatggagcccccaccggcacccccaccaacaccctgaaggagggcgcagctcctctgggccccacagtggcactcactggcatggacctgcaggcagcacttgccgcaggcgatcagggggctggtcccgtcgtcgccgatgtaggagttggcaggcagcggctccgtgttctcaccgccagaggtgaagcacatctcagggatgagcggtcgggtcttctgacggcttttggagggtaatgtggccgggcagccctttccgagggaggctatgggtgcctccttctcagtctgtagggcctgtaggggagaggcgaccttcaggggacagagccatgtgtggggcaggcgggcgggcggcgcggacctctctcagggcacctgccccaggcttcgacaccccctggctctggagggggaggtcggggagatggccagagccacctcggcccctcttctcactcctccagaaagtcaggatccccaaacactgtctgaccctgtccccaacccgccgaagaccttcccatgagggttgcatccagacacagagctcaggctggcctgtgtggcccctggtgctgggtggcccctggcgctggggtatgctgggggtggtgtgtgatgaacgagtctccacactctgcctggcaaggggaattaggaagacgcatgtctgaagtggcattccaggccctgtggctcccagcagcctctctggcctcacaaaggacagcaagtgcctggagacggtgtcggctgtcaggtcttgtttgtctcaggaaccagagcactaaatccagctcccagcagcagagccccaagacaggctcaccaccctcggcacagcactctccctggctctgtccacccagacccggccggcgcacaggcctggggggtgacgtccccaacccagggcagctctgctgatgcctggacatgcttggcatggggctaggagctgggagtgcaaagcatgtggccaggtcctgtcctggggaggctgcatgcccaggggaagagagaaggggggatctaagagatccgaggaaaacggctgggctgggtgctgatgcctgggatggccgtgggcagaggccagctccccatctgggtgcagaggacaggcgaggccagcatggaaagagcaccagaaacaggaccttagccaggtgcccagctcagctagacaggccagggtttgcgggagccccgcccggccacccaggtggtgtacctgggccttcactgcactcccacaccacccggcccatctcagcgcccaccagacacgggcgctccctgagggcagtgaccccgagcctccgcagcctccctctgccccatccaccatggctcatgttgcacatgggcacgttagtaagcttcattccaataaaacccagagaccaggctctgcctacggctgtcaggaacaagccctcacaactcggggtgctggccaacaccctgccctgcgtgagagagggaggcgtgtggggtgcccggtccctcgccctctcccaccgcccctgcctggggttctctgggacccgtgaggcccgcctgcccacctggcagtaggggtagaagagcgtgcagatggcgcagtagggctccgtgcgcgcagccgctgcgttgaacttcctctcggcctggaagctggccgccctgttcttccactgcagagacagcagcggcctcaaggcgtccgggtcactcacatcttcctccccggagaaaggggatgcctctagaagaacagaggggagagggagagagacacttgagccccctaaaaactcgtccaaggaatcaccccaactgcccaggggatggccccgggtctacagccctggctgcccacagggtccctggcccatagctccccctccacctgcctcctggctgccccattctccacaatgcccatcaagctgacactgcagcgtcccatcccatcaacaggagggggacacgtctgtctcggctgactgccacctgaggccagagcccccaaacatggttcctctgagcccctcccccaacacctggttctccctggacatccagagccgtccactcacccagggccttctgggccaaggactggccaaactcagtgcccagccctgccccggctgccctacacccgtcctggggtctgagtctgagtgggggcgtcggcagtgaccagccgagactcagagacactgtccttcctgtcttaggtgggcacagactcactgaactcaagggaggtgccagaggagtgcgacagggagtcaggaggggccgtgaccagggctaggaagccaaggcagcccgccccaggaagagctgcgtgacggggacactctcccggaaggcaggtctgctgctgagaagccgcggcggtctctctcccacctgttgcctgttcccattgaactctaatggcctccattgccagctgccgcaccccaatctccccacgtcccctccctgcatctcctgtggacacaggggtgctgtccccaggaagtggggtgcccactcctgtggcccaatcctcagcccaacctaaaggggagcctggggtcctgggatcagcccagctgtggcactgcccctggttcacctagaggagggcagggcagggcagggcaggctccccgaggtggaggcccaggtctcccatggtggactcaggaagcccttaggccaagactcctctgaaaacccaaaccagacagtaccgccagcggagcccagggaaggccctaagcggccccgaggccctggggatgagaacagagccactggctgcgtctgtcactcacaaccccagaatgcctggggttctggggccgtgatggtctcacaggcaaatgctccggtctcaccaaagggtcacagtggggtgtggggagtgggggagtccacggaggccccagagatgccttctggaaggatacctgggtagaaggcaagaccccttcccaagccagcccgcgggggcccctggtcattcctctgtccccgtgccgattcctccactcctgggagctcccgccctgtgatcccacgcgcttctagaaccctcctctccccacccctccaattgcatgcaggatgaaagacgccatccagaccattttcagattctacatgcatccccaatgaaaggccgaagcagaagttgaaaaactggcttagcaggacttctgcacacaagacagcagctctcggctgagggttaaatcgaagattccatctcctcccctcccactcaaagcttcgcgggagccttttgttccaacctctccaagtcctggagaggcctgtgctcagccctgggaggaatcttccatggggaggtacaagctccccagccctgaaccgcccatcatgggcagcccagccagcagagcagagccgagcatctctaacagcagctgcctccccgcacgaccacctgccccagtgacagcctgtcgctacggcagagccacagaaaggcctgggttcaggggaggagacccaggaagtgggggaaggaagccgcaggggagccaggccccccctccagcagcagcagagcgcggagcagggccgatgagagccgacctggggaccccccactcaccctcgtcacttgaggcctcctgcttcaccaccgacagtggggaccgggtgggcggccggcccaggggatggcgccggctcttcttgatctccatcttcaatttggaaaatgtggacggtgcctgaaacacacaacaggctgtagtgagggccccgctacagacccctgggtggggctccctcggagccacacaggggctcggcgtgcctgaggcctgagtctcctctcctggggtgactgtcccagcaaagaaccacagggctcctctgttctctaagtacagacaccccacctaccctgtgagaagagccacagttccctgtgaaaccagcagtcagccctcctgtcccctcctccctgccccctcccccgccaccagctcccctgtgccccacctgccccctcctcccctgccccaccccacctgcccccctcctccctgcctcccccgctccaccccacctgcccctctccggcccgggctttggtctccatgcgacctgccccactgctggctgcaccgtcctctggccccgtcagctccatgggggaaactggttccttccaggtcggacccttctgggcaaagtgctcaaaggcctgctggcaggacacgtgctcctggttgaaggctgccttgcccggccgcggcaccacgtacagcatggggatgatgggccgaggcttggcctctagctcctcactgggcacctcagggggcacgacattaaggggtgccggcagggggctctcctccatggctgcagggcctgggcccagcaccgggggctccagtggggatggcagccacagcgcctcctctgaggggaagtgagcaggcgggggcggcagctgtgggggca

SEQ ID NO: 9478 - DNA, 193 bp, Homo sapiens
ccacctgctcctgccacggcccctctgccagcttggggaggcccagggacgctgacctcacagggcctagggcgggcgggggggcaccccagaggctttggtttcaggctgtgtctgtccccgcacacagggaaggctttcgagatggagaaaagagggacacagtctttgtcgggaaatcgcagcaggtgga

SEQ ID NO: 9479 - DNA, 585 bp, Homo sapiens
ggaagaccagcctggccgcacagcacactgtggaccccagaacaccgtgagccctggggccctggggccctgcctgctccatctggaggagggggacaggggctcaggcccccacctgtgtgtctccaggccctaaggctcttgggacattctggaaggaggaaccgtggttgatatccaagggattcttgggctgtggggctttcagtgctaaaactggaaggtcccaagcagatcaggatgaactggtcactgctaacatttcaccacctccacctcccccaacaggctggaaaaataaggaaaaattaagagaaggaaattcatttctgcacactaaactgttgaccatgtggcacttaacggggtctggtttggagcacagcgcccacatctcaccacttgctataaaacccaccacgggctgcccccagctccacagtccgtgatgccaggaccagtggtaagcgctgagaccctcagcaatgaggctcccaagggccgagggtgacacttaacccttgacccacactgaccccagtaagggtcaagtgaggaccctcccccaacagaccctgcagccag

SEQ ID NO: 9480 - DNA, 14010 bp, Homo sapiens
tgctcttccttttaaaaactttatttaaatggagactcttagtcaaatgattggaaaaccaataacgaaaaatagttcttcaggttcttctcctggtaaggcggaggacacaccaaactgcactggccctgtcaggggacacggcaccctcgtgggaccaggctcagccctcggggtggcacgaggtcctgcaggctgcaggaccctcacactccagccccgtctggtgacccaacccgggcccgtggtgcatgctggggaaggccactggccggcccctgggcttcggctcctgaggaggcatggccccacaccctgcccggccataaatatatacagattcctgggcatccagggcaccaggaccgacgcagagctggggtcctgtccctaagcctgtggcacagcgactcttgacatgggagccagggagctgggaccgccgcacccctcccctgcctccctcctggggtcaccaccctcaggcggctgccagctggcctaggacgcggcggaactgctgggtgctgtggcccagctccttgaccctctccaccatgtcctgggccgcggaaggcgatgggtactgcaaggcagcggccttggtggtggccacgatgccgcgcaggaggtcgcacagcaggttgctgtagtgggtcacctggctgcgcacgtcagcagccttggcctgccgtgacagtgtgtccccgatgaacaccagcttgtgggcgctgaggatgacgaacttgctgtgcgccacaaagatcttgggcggctggttggtggccacggcggtaaagaaggcgtccacggcgttggtcagtgtggtcaggttggcctcacactgctccaggtagaagagcagcagctgccggtccgagggccccaggccgcctgttcgccccggggccaggggttgggctggcgtccagttggccaggtcgtggtctatgggccgtgacacctcctgttccagtcgttcaaactgcttcagctggggcaggagggaagcaggagcagggttaggctctcgggtgagttggaactacaggccgagacctgggcaccctgggctgggcttctctaaaagggccgctactcagagtgcatgggactgcagggaaacgggcagtctcctctcccggggacgggaccaggaaccatggcaagccttctggaggttgttcagttacccttccaccagtctcaaaaggtcagactccgtgccctgaacatttttgaaatgacaagatggacaacagaaaagtggctgcctggggtcggggggtcaccgtcctggcttgggtactgtcccacgtgacttgagacgtggcactggggaaaatggctgaagggcactggggacccctcgaccctatctttgcaacttcctgtgaatctataaatatttcaaaatggaaggttaaaaaaattttccccttagttcaaaagtaacatacacattataaaaagattcaaatatatcaaacagaaaaaacgaagatgtcacctgtaatccaatgcccctaaatagaacctctgctaaatcatcttccagaaccacacacgaaagttaacatttccactcccgtgcctaggagtcagctgaaggggacaatgtgtcctcactagagccgctctggctccggaagtgaccagccacacccagactcaggactggtaagctctgtgccaccctaggcgcaaagatccaagccacaatgagcaaaaccaataggaaacctccccttcctaacacttagaacctcgcactgtcccccttaggcagccacttggtgaaatcctccatctctccgttcccttagccagtgagatacatactccgctttttttctttgaaaagctctgatgaggcagggtgaggtggctcatgcctgtgatcccagcactttgggaggctgaggcaggtgaatcacttgagtctgggaagtccaggctgcagtgagccctgacagagcacaggcaacaagctttgtggggttttttttttttcaatactatttttatttttataaagaaggagtcttgatctgtcacccaggctaatctttttttttttttttttaaatggagtcttgctctatcgcccaggctgaagtgaagtggcacgatctcggctcgctgcaacctctgcctcctgggttcaagcgattctcctgcttcagctgggattacaggcctgcgccaccacccctggctaatttttgtatttttggtaaagatggggtttcaccatgttggccaagctggtctcaaactcctgacctcagatgatcctcccgcctctgtctcccaaagtgatgggattacaagcgtgagccactgcacccagccctttttattctttgacaactcttcatagttatataatatcccactgcataaatgtccatactttattgaatcaatactctcctattagacactttgtgggtggagatttcagattcttcaccgatacaaaaatggggcaacagatgttctcatcagtaagtcttcatggacttgcatttaacatggactttatgtccttggccttggaattctacatctttaaagttcttcacatatattcttgccctttaatccagcttctagcaagttatctaagtgattcatcagatacgtgcaaagactagtattcatcacagcactgttcacaaaagtaaaactctgggaacagcctaagtgtccaacagcaggggactggtgaagtcagtgctggaggcacacagaggacggacaaagtacacgaccacttctgaaaacacggcgatcccagagttctctctctagacagagatatagacctatatattgttgatatttcaggaggttttttgtttttgagacggagtttcgctcttgttgcccaggctagagtgcagtggtgcgatctcggctcaccgcaacctccgcctcctgggttcaagcgattctcctgcctcagcctcccaagtagctgggattacaggcatgtgccaccatgcccagctaattgttttgtatttttagtagagatggggtttctccatgttggtcaggctggtctcgaactcccgacctcaggtgatccgcccgcctcggcacccaggaggtttttaaaacaattttattttattttttttgagacggaatctcaccctgtcgcccaggctggagtgcagtggcgcaatctcggctcactgcaagctccgcctcctgggttcaaatgattctcctgcctcagcttcccaagtagctgggactacaggcgtgtgccactatgctggccaatttttgtatttttagtagagatggggttttgccatgttgaccaggctggtctcaaactcgtgacctcaagtgatctgcccgccttggcctcccaatgtgctgggattacaagtgtgagccactgtgcctggccacaatttgtattaatgtatacagacttgggtctcactacgtggcctggctggtctcaaacccttggcctcaagtgatcctcctgcctcagcctcctaaagtgttaggattacaggtgtgacatttattcttttcttgggtgttttctttagtagatttaacaggggtgcaggtgcagttttgttatgtgggtacaatgtacccattaggtaatttctcagcccccaccccctgccaccctgccaccgttctgagatgtcaatgtctagcctctcctgagtgtctccatgtgccaggtacttcccaggcatcttccacttttcagtgattctcaccgagctctcatgaggcggctgcagcctcactgctgtgtgtcgtgggtctcaggcccctgcctctgccacctccttggtgcccagaaggtaggcgagggagatttgacgggtgatatttttatgttcacttcgtgctatcctgtattttcacttttaaaattatcttcataatcagaataaagctcccttagtgtttttttacatacctctttcctaccctgaagaactgattcaaaatatgaggaaaattctattaacatgtctgcatataaacacagcagtatatttataataaggggccagatgtggtggctcacactataatcccagcactttgggaggccaaggcaggtggatcgtttgagcccaggtgtttgagaccagcctgggcaatgtggtgaaacctttgtctctataaaaaatataaaaatcagccaggtgtggtggcaggcgcctgtaatcccaactactggggaggctgaggcaggagaatcgcttgagcccagaaggttgaggctgcagtgagttgagatcgcatcactgtactctagcctgtgtgacagaacaagattctgtgtcaaaaaaaaaaaaatactaaggaagtgtgggtacaatacaaacattcaatagacgctaagtggtctttgaaagaatccacaagaatgcttaacgccatggcagatgctgggacagaagagtcgaatgcccacaggacaccatcccggccatgcagggagcagcttggaggaaggagcagggcagagccagccccgtgctgagcctatggcagctgtgaggggtctattttctgctctcaccccactctctaattccctaaatgtctccaacaattactcttgaaaactttaaaataaaccaagtgaaaagatgaagatggtcaggaggcaggggggtggcaggccgggcccagctctgagcactgtcagacaacatgagaagctggggacccggggtcggccctgcagggcaagagctgggggctcagggggtcagcgggcaaagctgggccttgctctgctccggggcctcacctgctgcaactccagctggctcttgccctgccgcgtgatgctgcccttttccagcagctccttctgggtcttctcaaactcctccttcccctggagggcagagacaggggctgcgctgaggccagttttctgagccagaagcacaggccagccctgtggcgggcgcagtgagctgagtggccaccaggtggtgctgcgtgtgcgcgcacacacacgcacacgtggacgcacacacacactagcacacgtggacacacacacacacacaagcacacgtgaacacacacacagactggcacgtgcaggggcaggcagacagacacacacacacacacacacacacacacacacacacactcccccaggctggcatatgtgggacacagcccccccaggctggcacatgcggggacacacagagaaggtggcttcctaggaagcaaccctggcagcccctttcaccgcctgccagctcaggaagagactgggcagagggtggggtacccgcagaaagtccgcaagctccaccctgccttcccaggctccaacaccaggaatcacacccaatccctcccccttggcctaaaggcctggccacctggtccctgcccctggatgcctctctggcccagctcagcctggaatgttccttaccaggactcccacccggctagcacccaggcctctgctccaggggccagcctgggaggagcagtcccagccacctcccaccacctcctgctgctcccccacgctcagagcatccttgtgtgtgtgcacatttctgcagatctgtctccccacacagaacagcagagtcaccgctgctggtcaccagagataccagcccgagggactcaacgaagggctcgatgacatggccaccctagcacatggggccaatgtggggtgagggaggtcaaagtgagaggagggtgcagggccttgccagggaccaggccccagctgagaacaaatctccccctaagcacaggagcccagcgtggcagaagaggagccggggctgggcaggcggcacccacctgtaggtggacgtagtcatagtcctccatccagcccccctcgctgttctcgtactgcccatctggcgagtcctgggaggtgaacttagggggtgagggcaggggtcgtgactggatgctgctggtcttgtcagtggggttggggtgcagggtgccacccccctcaggccccggggcagtggccttggtccgtctgaagagcagtgaggcattgccgtgcaggaaggaggccagctgcttggcgtcctcgggcacagcccgcgagcaggccaccagccggtccaggtcctcaagggtggctccagagcctccccggccagcgtcgagggcctgaccatgtgccaccagcgtctggtgcacgtcctccatcttctgcagctgccggctaagcttggcatgcagggcacggtcagatgtgtgggcagcattgcccaccgcgctgcgggcaaactccaacagctcgtggacggcactctggacagcggccacagcagcctgcaggtcctgcaccagcggctcctgtggctcagaggggctacgccagctcccagtcgcaccggcgctgcctgccaggtccagaaggtgggcaacggtggcgctcacaccctgctgcagccgtgccaggggcctccacagcaacttccagctccaggggttcccggcccggccctgccacctccaaggaggacgcagactggctgctggcgtgtgctgccggtgctggaggccgacaggcgcttgccctctgccggggcttcacgttcagctgggggaggcaccgcatacacaccactgtcgaccacgccaccatcagccacctcaggaggaagcacccgttcacggggcacatcgtacagggtgcccgggccaggccgccgcaagccagggggcacgtcgtagaggtcaggagccgggggcggcacgtcatacacgtcctcggccggcggggagtctggagggggcgcagccagtaccagtggggtgcgggccgggtcaaagggcttggccttggcgaaggcggggggcacatcgtaggtctcctcacgcagcagtgggccatcgggcacatccttgctcaccgatggaggaacgtcgtagacctgggggacaagcggtggtcaagactgtccatctgtccatctgcccaccccagggactgggggcagcacccagccacacacacacacacacgtacacacatacagacacacacacagaggcacgcgcacacacacaggcacacatacaaatgcagaggcacgcacacaggcacacacacgcgcacacacactcgcagccctagcacacacatccttcacaattcctatccatgacagctctgggacgagccggctctggagccaggtgaccacccctgtgcctgaaggtgggagagcttcctcccaaagaattgcatgtgttaattcacataattgtgtcactgcagacactcactgaaaggttagctgtgatactgccactgccaccaccatcatatcatgatttcatcaccatcaccgccgctgccacctcatcaccaccatcactgttaccacccagcaccaccaccacgtgtgaactttctactctgcagcaggtgtgcgactgagctctgtgtgtattatcaggggaccaaattctggtttgcccaggacagtgctggtttgtccctgatgcccccacataattactagtccccccttcactcttggaagtatcccaggtgagatgacacatcccgtggtcaccttgcggataccctctcaggagctcatggagaaggcctcgcaacaggcggttctgccgacaaagaacctgaggctcagaagacagcttgatttcctcatctgtcaaccatccagaaccagggtctggagccagtctcttcctgcccgccacccccagccctgcagacactggtcagcacccctgtgcacacacccagacaccccacagcctcagcctggccctggcattgccctggcatttgctcactgcgtggtggttggacggtggcaggcccttctccacactggggggcacgtcatacacctccagcaacgggtctcggccattgggacccttgacagccatggggggtgtgtcatacacctggggcagaaacagtgcagggttaacggcgccagggccacttgggggaataggaaaggtgggaaccccgcagcaccgtccccaggcctggccggggctgagaagatgcagctctcggcccagggccaagcagaggcacagacttgccgccctgccctcccaccgctgcgcaccccacacctacctcctggccatactggctgggaagcagcccccgaaccgggggcacatcatagatgtcctgtggccccggggccagcaggtgtcgcgggatgtcgtactcgtcctgctccggctgggcggcctcgtatacatagccctgccccacgcgggtgggcaccaccacctgggggcagagagccgacttcactgctgccctcaaaccagcccttagggaggctccactcacacctgggagccacgtccttttaggaggtgggcagggcacaccaggtggaagggacggggctccccaaggatgccagttctcaccccctctgcaccatctgaccttcctctagcagaacgcagtgccaggtacggcaagaactctgggttttattcagagctgcctcgtcctgggccaggacaccaacgtctctacagcctgctgacccagaaggctccacagaggagcatgggtatgagctgatgacaccggtggggtgaggggctgaggccctggctctggagggcactacccacaggcaaggaaccccccgttactgggggcgcctagccccacaggacaagaggccacgtcggaggcctgggagtctgctgcccacaccacctagctgtagcctcctcagaagggttggcccagcaggggactgcatccggcccaggaccagatagagcctagcaccccctgccccacagcacagcatggggagactctggaggacagggccagaggggcaggttgggtgtgtgctggggggcgcagcagctgggaccaaggccccctccctgccgcgcctgccccgggggagctgcctgcagcaggtaagatccccagcgacctgaaaggatgaggcctagtgggggaagtgggtccagggccagccctcccctccccaggtgctcttaccatgacccagagcccagggaagccaaggcccgcacagtgggtgaagaggcaggcagcacaatggcctgcccagggccacaggacccctcaccagcaccagcctgaagcgggtaggggccatgccaggcagcctccttccctgaaggtctccctgccttggggaggtcaaggcctccctggtgggattctccagcccccgggcacactgcgcccacacgcctccaccaccaggctccctgttcagctctctccactgaaagaccttttgttccttcatcaaaggggatgtctgggacagggttgactcagggcctccccgcacatcccccagggcagcagcgccaaagcagcccctcccccgggcccagtgcccctgaacccctagaggccctcccaatgcaggcaggcagccagccctgcttgctgagggtgctgtgaggggggcgctgagcatgggggtggcagaggcgccagcacacccccagcagccgcaggcctggcagagccccccgcagcgcagcagaactgggcccactaggtctccagcacgcctggtagcagagtcccggctgggggcctccgtggggtgtccccgcccccttccagtgcgtctgggagtggatttggcggctgcctctccagactcatctccctccacgcgccccagacttgagtctcctccagaactatttttagatgcagggacctgccaacagcggggcaggcggggcggagggacgtggcaggttggctgggcctcgaggcacggcctgaggcttctccaggcctcccagcctcccaaaggcaggtggggacccagcctcaaggctcagccaggacccagcaccagcaggagggatgagcatcctccaaaagcaccctgccggtggccatcccaacctcacgcggtgaggcccaggggtgcagctggacccaggcctgcctccccaggcaaatggccgcctgccactcttggagctgagtcgggtggcagtaggcagccacagtgaccaaatgtttctgttagaaaaacagagcaacgcagccaccagggggaaaagctctttaggggaatgactcagccccactgctaatcacaggccaccctgctgcacacctgagaccccactagcaggccgtggaggtcccccgggggttaggggaacacagccagagcccaggaggagagaacagaggcacagtcactgacataagacccacacggtctctgacacacatgcctcatacaatgcagagaaaacacagcacaggcccactgccaggtgcacgcacagaacccaggcagccccagggccagggtgccgcccctctcctcccctactatcaggcatcaagcggggggacaagcgaactcaggaatacatcccagcctcccggtaagggccccagaggcaggtgtcaggtcggaggaaggggacaaagtgggcccccgccctggagctcagtggctggtctcccccttctgcaaaatgggtgtcgcccctgacctgggttggctcccggctctggcacccccaggtcccaatccaggagcctcgtttcctccttgggaaatggagcaccacaggagcgctgcgaccacggccaccaggacacaccccagcatgaggggctcacccgacctgggtcatggtggcctgaggggccaccaccatagcccgctcccctccctccccagctccaggcaccccagcctgaggtcccagcacaggggagcctggggcaagatgaagcttctagggcgaggagggtgaaacacaggcccgacaggaccacgtgcacgcctgacctcacgccatggctgtctccttagacactgaccaggggcactacctgagcgacctcccacagacgccttcccccgggggtcccatctgaccatgaaagagcctctgccctcagattcctacagcccacacccggcccaaagagtctcggtgccagtgtggccctcacctctccctcagccatacgggccaccaggctcccaccttagcaaccactggaccctgctccagggcccagggttctgaccctcctggccaccatccttgtcactcaccctcttggcttcctgagagccagtgtccctcccgcccacgtgaagtcctggcaagggctccttctcagcccagccaaccactaccctggaactgggagactcagtttcccaggcatttgaggggcaggcctgaggcttggaggggagcacctggaggttcagacacagatgtcccgcagccaggtgttaccgccgtgccaccgtaatgaaggcatgagcaatcggaaactgcccagggcccgccccagcagagggggcaacccagcaaagtccaaggcggctcagggacaagctttaagaattcaacaaaatgcttttgatatctaatgttggatttacaactttgaaatgcaaaactgcatgtataaatctgtgaaacacagggcagatactagacaaaatatgccagaatttcccagtgattaccgcgattggaaaatttcatctccagactttcccatacattatgcattttctacagcaaacaagcattgcttttgtgatcataaaatacaagcagacacaatcaagactgggggaggtttcctgggggagagcagccaggcccaggacacagggctctccttcctgggccatcagccaggtcagggcccttggggcacaggtctgggcagctctaccagtgggcatgggcagagaaggacccagctggctgagcccctgatgcaattgagagcaggccccctgccggagacggagacagaacagctgccaaaacacagcctcgaggccgggctctgtctgggggtctcgctgctgctccccagcccacagggcttccagccgcaccaggacaagcttcactgcaaaggcgggagaggaggggtggggatgtgcctgaccttggggcatgtgcagtgtggactgtgtgtgcgtgtgcatacgcacatacatttgtacgtttgtgggatactggtgggtgcacacgctttgtatgtgtggacgtacacgtgtctgtgtgtggggtgagtatgcacgtgtgtttacacatatggggtttgggtgtgtgcgtgttcatgcatatgatgtgcgcatgtgtgggcgtatacgtgtgtccatttatggggtatgggatgcagatatgtgcatgtattcacgcacattcatgtagcgcatgtgtgtgttcgtgcatatggtgtgtgcatgggtgttcgtatctgtggggtacaggcatcatgcacgtgtgttcatctgtgtggggtgtgggtatacctggactgtggcctgaggctcccctacaggacactgctccctgccgcctccccaggggataacaggaccctgctcctcttgctaaagccagtttgggagcacccccacccaggcaccccacgccagccaggctcgcctctgaccagatggctgaaggagcaggtagagcaggaagtgggagccagtgacccaggttcccctggtggccaggcttggtggcccatgtccatggagtcccccacccgccaacgacctccggccatgcctcctgggtaccaggccacccatgggcgggggtgggggtaactcccagctgactcgctgcccagctggcaccaatgaggtctccacctcagccctgggctgagtgtctagtgctgactccttcctacaggcaggtgagcttgggaggcaggggccctgtggacttgggaagcgggctcagggtctggaggccagaggtcttgtccccaggcccagcatcccatcagcaagagcccaggaggctctcagggcagtcctcctctagcaatctcaggggcagcgtcctcccaggagtcacatccagatcaccatacgcacccgctggcccctagcatgttccataagtggagaggggttggcctgtggaggcaggggcggccagaagatgtgccggaaccccatctagaggctgacacgtaaacccagatggcacaggggagcctgagcatgaagtggctggcctctcccttgcgggggcccagcaactgccgaccccatgtgccaagccccgcctgcccactggaacgcctcaacaggctgctccctgtggttggtgacaccaccactcgggtcggcttggctgaggccagcggagcatctcccctctgggtccattcacatccatcttccccggacaaatgaacaccccccaaacactcacttcccactttgaccccagaccaaacacacagccactcctggaatgccggtgattgagggtggctggacccttctgtgcccacaaaccagggcctgggctatacctgtgtggctgcacaactgtgccaggacagccttacctttgccgggggcttcgtgccctcccagctgcgtgtgtccatggacggggggacctggtagatgtcatgccccatcccggcagaaggtggcacctggtaaatatcctgggcagggcctccaggccctgggggcacctggtacaggtctgtggccgggctgggaaacgggtgatggggtgtctgcttcgagaaggtggatgtctgcttggctgggggagactggaactgagggctgggacccgggacttggtagaggccttgctgagccttgctgggagtgggcaccaggtagacgctgtctggctggggctggtaggtgttggggagcatgggcgtgtactgggaggccggaggcgctggggcatggaggccaggctgaggctgggccggggtggcgggagggccggggccaggccctgctggcttcttatcatacatgcccaccaagatcttgaggcggttcccaggcacgatgccctggcgcccatgcagcgagcagagccaccagccgtccaggccctgcgtgtcctgctccagcaccgtcatgatgtcacccttgcggaagg

SEQ ID NO: 9481 - DNA, 417 bp, Homo sapiens
ccccagcggtgccctcggctcacaggaacccgtccccttgtgcagctgttcctgccccaatctgccctcactccagatgccagctgtgggcatgggcaggtgctcactgtggcagctccctagggttgcaggggccatgcccaggctgtgctttctgggccccagaccctgcagctctgaaactgccccctttcttgggcccaggctctgccctggctcccagggccttgtggccagctgcaggcctcaccccgcctccaggagacacccagcctcggcgttccttggttttcttctagagagacccactcctcctctgccctcccgggagatgccacgcatggcccttgcccccgggtgccttccccagaaccgtcacccaccccgggctgctctcatctgccaccctcaggcagc

SEQ ID NO: 9482 - DNA, 2769 bp, Homo sapiens
gcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttgatgtaattccatgtaaatcattgcttaaccctcttatgggatgaggatgagttattaatgtattgcagcctactggaaaggagggggagttggttaatagcagatacttttcttctagaagcttatgttttatgctgtttattatgtaagatcctgtatgtgtgttgagatttagaggtttcatttgttttgtctgctaataaattgttactctaataatac

SEQ ID NO: 9483 - DNA, 1034 bp, Homo sapiens
ttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcagcctcccagagtgttgggattacaggcgtgagccactgcacttggccaagttatttatttttaatctctcttgcccttctcccaaggcaggcttaagttgagactattataggtgtctaataacctgtgacagagtaatgagtacatgcttaagatgttataattagccaacaccaacacagcaaaaaatataattccagccaaagattctggaaaatccctcagaaggagggataacaggatttgacctttaccagcgatttctgtccatatgtggatgtaaacagttctggaacgttatgcatgcagttagcgaatccttgaattatgttctggtttgtacttgtcccatccatccaaacaagagattctgcttttggtagccatctgtagaaacatttaagatgtcactagaatttacatttcatcctctctacttgggttgaggttgcctatacttgcatattgttaaaatgttttggttgctgatattcagaggaatgaaacctggaaccaaagcctaatttgccgataaaaaaactgttttcggccaggtgcagtggctcatgcctgtaatcccagcacgttgggaggccgaggcgggtggatcacctgaagtcaggagttcgagaccatcctggctaacactgtgaaaccccgtctctactaaaaatacaaaaaattagcggggcatggtggcacgcgcctgtagtcccagctactcaggaggctgaggcaggagaattacttgaacccgggaggcggaggttgcagtaagcagagattg

SEQ ID NO: 9484 - DNA, 289 bp, Homo sapiens
gctgggcacggtggctcacgcctgtaatcccagcactttgggaggctgaggcaggtggatcacgaggtcaggagttcaagaccagcctggccaagatggtgaaaccccgtctctactaaaaatacaaaaattagccgggcgtggtggcaggcacctgtaatcccagctactcgggaggcttgcggcagagcattgcttgaacccaggaggcaggggttgcagtgagccaagatcaggccattgcactccagcctggacgacagagcgaaactccatctaaagaaaaaaa

SEQ ID NO: 9485 - DNA, 6565 bp, Homo sapiens
cgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtcagtaccgcacccttcccatttgctgcctgtaggtccaccccgcgcgtgcggtccccaagtggccatgccaccctgcacgccctccccgcgtcagtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggtgaggggcttacagccctgtgaatggtgtgggaggtgaggggaggggggtgcctgttactgaccagtgtttaattggcctcaagctcaggagaggtaaggggagccaggaggccccctctggagcaggtgagtagaaggagggggctcagctgcccgcccacgactagaaaacccccagcatagacctgccggacggcaggaccttggttaagatgggaaaacagtagggtttgggcacaggaggtctgggcccccaacctggtgaccgttggacaccctgtggatataggaaggaagctgtggtccttatctagggtgcctgcgaaactcaagccagtggggaaccaagcctgcagaggcaatactgctgtgtgactgtgggccaggcccagtgctggtgctgctggggccccatctgaggagacagttgggtctatatccaaagtgtcctgagatgggcagagttgggaagggggccatgggctccaggtggggaaggcagtcaagacaggccaaagctcagcctgatgggtgcatgagtggggccccaggatccactaaggcagtgggcatagcccaggtagttgaaaaggctgggagctggaggagactcggaacatagggagaagaaagggacaggaagactcccgggcagtttttcctatggagggaaccttgggtaggtttgagcagggggtatagtgtctgctttgcatcttctatcccatgccctagtggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggtgagtgtgggacaaagtgcagcccaccactccccagttccagtatgcatggtcccccctgcactctgtcagcccttccctgctccaaccccaccctccctcctggcacagcccagcatggctgttatctacaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggtatggctgtgacagtttatttgttgatccccctaccctcacctctcacctcttctgcaggtcccttatccctgcagaagtctccagatccaccttggccctgaggccattgatgggaggatgcctgtcctttgcctttaccccccacctggctcaggagacagggtggctgttttcttccccattcactcattaccattcactgagcacctactgtgtgtcaagccctggacgggacataggcaatgggtaactagacaaacaggcatacagtagcaggatccatgtggcacaggggaggtacagaggctttgggaacccaagtgacttcactccacctggggatccaggagacctcccagggcagtgatgtcacagcagagacctgagtgctaggtaggaattaaaccaggcaggtgaggaggtgggagctgactgttcttggaagagggaacaaggtgggcagaggaaagaaggggacttgtgacagttgtgggaggacacagtggtgtattgacaaagacggaacatgggagggaatgtaccctcagctcactgtaaagcccgctttggtgtgcacctgccactcgatgcccggggcatcatagccagcttgcggtgtggctgctttaaaaggcccaagagacccctggggaaacatgctttccccagctcctcctgtaaggatggggaggagctgggggagctttcctggctttccctgccatgtggaaggtgtggccatagctgcggactctaagcttacacccccctctctcctgcaggtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggtaagtggaagctgaggtctaggggtctgagtcaggaggtatggccctgttctaggaaggtcccaggagaagaccttgcctaggggttggtcctaatctaggcgttctcagcggaaggccctgtcctggagcatctgatgagggaggcatggctttgccctggaagatgttgaggggtagggaggcccagcctttggagtgctggcctgaggggagatattctgagtggaaggcctgagaagccactcagagactcgatacaaaggggccctacttgggctgggtgagtgtctcacacctataatcccagtactttgggagcctgagatggaaggattccttgaggccaagagttcgagaccagcctgggcaacatagtgagaccccaacctctaccaaaaaaacatttgagacagagtcttgctctgttgcccaggctggagtgcagtggcaccatctcagctcactgcggccttcacttcctggttctagtgatcctcccacctaagcctcctcccgaatagctggactacagatgcataccaccacacccagctaatttttatatttttgtagagatggggttttgtcatgttgcccaggctggtattgaactcctgggctcaagtgattctcccgcttttgcctcccaaagtgtgggattacaggtgtgagccactgtgcccagcctaaaaaattattagccaggtgttatgcacctgtagtcccagctgcttgggaggctgaggtgggaggattacttgatcccaggagttcaaggctgcagtgagctatgatcatgccactgcactccagcctggatgacagagtaaaaccccgcctctaaaaccaaaccaaactagagagtccctactgtagagttagaatcagattgtgacagtgaaccagaagagtttcttgaatgtggatgtgtgcccacatggatctggccagcccagcactggcttagcagctctctgcctccaggatgaccttgtgcagtccattggtgtgagtgcagcactaggggcagccggcgtggtgctctggggggacctgagcctctccagctctgaggtgatcattgcccctttgagcctgccatgtagcacatgctggggtcccagggtgggggacggccatgtcaagattatagagcaggcatattgacacatatcttcccttctcctcaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgcc

SEQ ID NO: 9486 - DNA, 6565 bp, Homo sapiens; identical to SEQ ID NO: 9485

SEQ ID NO: 9487 - DNA, 4867 bp, Homo sapiens
ctcgccttcccggcgacctgtttggcagggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgagtggggtggggggcgcgggacagctgtatgagcggcgggcgggggtcctgctggatccccttggttgttctcgagggccctgggtggggaaccccctcggccagccccacgcagcttcccataactctaccgaggctggcacgtgccccagcagtcattggccacgtgcgtgcccaacttgagctcgctgcccactgcctgttgggagtccgcgctcccagcggtgacccggccagcccctccgggcctcagttgcctgctgggtggacaaactcaccggacagggcaggaagccagtcctcttgccaaaccctgatcctttcctggactggtcaaggaagttggcgggagtcctggcctgctccggtgaagagagggagggggctctgttgggaagctacctggttagggccttggcagcttggcaggcctgactccacaaggtagctgagtatcctggagcctgaggcagtcttgggactcgcttatcagcttagaccaggagcctatcttaatgcgttaaacacatatgtttactctgctgggatggggtgcctaccacgcacaaatttatttatttttattcttgagggggaagggaggagggccgggcacaggaaggaggaaaatacctaggcacaactttaaactggtcaccaccatggtgggttttgggtgggggacatctaatagggtgtggaacatgttcactgagtggtgtcagccccagacttaggactcagggaggcctggggggaagtgcttctgggtgagtcctgagaggatggagaagagagcaagttgtacaaagacctggcagctggagggaccccagcgcagtggagtgaatgagggaaggctgggctgctccggcaggtagaatagtaagataaaatgggagcaggctgggcgtggtggctcacacctgtaatcccagcactttgggaggccaaggcaggcagatcacctgaggccaggagttcgagaccagcctgaccaacatggagaaaccctatctactaaaaatacaaaattagctgggtgtggtgtcgtatgcctgtaatcccagctactcgggaggctgaggcaggagaatcactggaacccgggaggcagaggtcgcagtgagccgagatggcgtcattgcactccagcctgggcaacaagagcaaaactctgtctcaaaaaaaaaaaaaaaaaaaaaaggtggcggggagcagaggccagtgcgcaggctggactttgtcctgcagatgaggggtgtgagtagttcttagaagtagggccagcctggtgatcacaccctgtccaaaactctgccacagcagccaaccttgccaatgtcagcccttggccctggacagaccccacacacaggagtgcaccagccctactgaactgacccttggctttggtttttcatctctgagagggacaccattctatcttttgggattatgaggtcgagtgaggtacccccagccatccctcatcagtagaggcaagttgagtgtcctattccaccttctccaggtgcccggagcagtgcccaagctgactcgggttccagtgacgatgaggcagccagtgaggcccgcagcaccgccagtgaatgccccagccttctcagcaccactgcagaggacagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaaggttggacctgggggtgtgtgggagacttaaactgggcagacactggcccttgctgcatgggctgactggaaagcatcccacagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggtaggggtggctgtccactgggagggggaggggatctcaaagaggcccccaagccacacatatagctcagcctgccccttccctaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggaggtgtgtgtgagaacatatgtgtcctagcaagggtgcacccccaggcatagcagccaagcccagttgtgttggcacctctaccctgcagggcggtgaatgcgaagaagagatagtgcgcttcggctttgaggtgctctacatggacagctgggctcggcaccggatctacgctgccttcaaggaagtgctgggttcgggcatgcaccaccacctccaggtgcggggacggacagggaggggacatctggtgtggttgcttcagtctggcctgagctcactgccctctgccccccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatcccaggcttgggcccaactggtcttccacgatgtcacctttgccctccaaggcagtcttccccaggtggtgcctctccccctactcagagcccagcctgtcttt

SEQ ID NO: 9488 - DNA, 1145 bp, Homo sapiens
agctggagtggtgctctgggtgagctgggaaaatacaagaaccaaggtgagcttaggcctggcatgagggtgggggtgggggaggggtggggccattaagctgacggggtagaccctgacttaccctttctacctgcaaagtcctggctgaccagcaggtgagtgcctcagtgccctgggtgggtccatacatggccatggtgtccctgacgctatcctcccttcccacctaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactta

SEQ ID NO: 9489 - DNA, 1145 bp, Homo sapiens; identical to SEQ ID NO: 9488

SEQ ID NO: 9490 - DNA, 4867 bp, Homo sapiens; identical to SEQ ID NO: 9487

SEQ ID NO: 9491 - DNA, 7238 bp, Homo sapiens
cggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaaccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtaaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaa

SEQ ID NO: 9492 - DNA, 4966 bp, Homo sapiens
  misc_feature (2355)..(2355): n equals a,t,g, or c
  misc_feature (2360)..(2360): n equals a,t,g, or c
cggccccaatgcccagtgacttccaggtcctcagggccaagtaccgagagagcccgctggtctccgcctggtcctagtagttgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagcccgggtgggccatgagccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagattagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgactttcnttttnattaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgccccgatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaaccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtaaggtgtgattgcactattgctctctagcctggaaaacagagtgagaccctatctcaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatctgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggggggccctggtgttactcacgacagggagggagacgcttcccaaaaacctgcagggctatttcccagaatttggttttcaaggacaaaactttttgtcctgtaagatatatgcagcctcacagaagcagcctctgcctccactttaccagctacgtttttatcttatgcacatggggctcccttcgaacttactccactgatttaaaataaattttctgcctggc

SEQ ID NO: 9493 - DNA, 1487 bp, Homo sapiens
tgccttttttcctgatattaagttttatagtaaaaaagcaactagtgattgcacaaagaatataaaaatccactctttttacaaaggtgtgaatttaaataacgttattgattggaatatgaaaatagaccaatcatttaagagctttttagcaaatgattcaattcttactctttttctcccaagattgaaaagcataatgtatttctctaaagtaggaatctagagagcccctgtgagtggacaaatgtcagtaacacttgaacacatgagaagataagtgttatgttgtgataatttaaagttaaatttgctttttgggtaggatccctaaatagatgggatttttaaatagatgatatatagatgacaattgcaattgtcattttaattattttccctacagtaaagaacctagctctgagcagtgaaattgtaatggcactttaaaggaagtaagccgttaactgttctctagtggagcgatctccaactgttttggcactagggacgggttttgtggaagaaaatttttccacaggactgggggtttagggggatggtttcaggatgattcaagtacattacatttatcattagattctcataaggagcatgcaacctagatctcttgcacgtgtggttcacagcaggattcgagctcctttgagaatctaatgccatggctgatctaacaggaaactgagctcaggcagtaatgcttggcaccgccccccaccttctatgcagcccggtcgtggcctggggactggggacccctgctctagtcagtaataaggtacttgtgccagaatataaatcaacacattgcttcctttatcaaagaagtcttgttatttaaaaaaagtcaactgagccagtatgattagtgatgtaattgattttcattctggcacaagcctctttcattctggacagctcacaaatagttaatggaccatgctttgaatagccttcctctaagcaacatttataaatactgatattttagaactgtttacatttcttctgtttatttttgaattttcagtttgatatcttgtccttattcattgttgtataaacaactgtactttaatttcaagtagtattaaaagtatttcacttcagtttggggggattattatcaatttataattttataaaagtattttaaagaataattgtaaattttccataaattacaacttcctgccatattttattaaataataatcttgcttaaggcatatagacagacattattatgagtattccagtaaaaaaaatctacatcaacttgaccattctggctaaaaattaaaaagcacttttttatatctgtggttgtcatttgtttcaaagcatttctaaatttattgttcttaaaagtatgtctgcatgttctagcctttgacctaggtcatctatgaaccctctttgtgtctaataaacatatctgtaaaggcatataaatctgaaaacaa

SEQ ID NO: 9494 - DNA, 1244 bp, Homo sapiens
ctcccccacaaatgataaattagtgtttttacaaatggaggcaatgatgtttagccatttacttggatacataaattgtactatgtccacattgagttttttccctgtcactattctattttacaaattgatggagacatatcttgggttaagaaatttctttcacacacacacaatggtttctttagctacaaatctgttttttgccaatcatctgagaaggccttttgttcacatatggggaaggtaatctcatgtttgtggagtatcttcatgggtattaccaccactatttacatgaagtcttcaagtggccttaggaagccgctggtaactgaacaactttctctaaaaagccaagctcatttttaactagagaatctgggaaatactgtgagttttttctctttccttttaaaggtacaattattataaattcctaactgctcctaaaatcatatagaacatttccagagccaaagaatttctaagctatagtttaaaatgatagcattttggaagcaagcctgaattcacttcctataatgttttccagattgtataagcaaaggctattattgctgctgtggtatagtcactttggtggtggtggtagcaggctagagagaatctcctttgccctgaagtctagaatgtaaatttgtaccaccaaacacaatagccaatattataaacaggaagtaagaaaaaaacctcatctcacttgcaaaagatcagcttattttcaattgtggaaattaatttgttatagataacagtagatttgagtgactttatttacttttcctcttcagtataaaaaataatattagtataatctcattacatcaatatattgaatagttaagttttttcctcttttaatatttaatatttgccctactgggcatgagttggccattattgaagccaggtggtgagtacctaagaattcattctactatttttctattttcatatacctttggaatttactatcataaaattatttttaaggtatatattttaaaatcttctctgttagctagtccttctcttgaaccacattcttcaaaagttctcccacagctaagttataaagagcggaccacttttggcagaaaaaaaaaaaaaaaacttgccttaattctaccaacaccttgcttttcatacaaactctaacccgtgatcttgatccctgtaacaacacaaatagttaacaactatccctatttattcttttt

SEQ ID NO: 9495 - DNA, 1244 bp, Homo sapiens; identical to SEQ ID NO: 9494

SEQ ID NO: 9496 - DNA, 192 bp, Homo sapiens
ctcaaatatgagaattcaaatcaggagttttcagcaatttgcttatttgcctgatgatatattaaatatcagtatgcttttccctcaagttttagtgactcagtgccttcctctttgcctcaaaatctctttaagcttatatatgccattgatgtgattaataaattaattctttagatctttttttctttt

SEQ ID NO: 9497 - DNA, 192 bp, Homo sapiens; identical to SEQ ID NO: 9496

SEQ ID NO: 9498 - DNA, 1399 bp, Homo sapiens
cccaacatcctaagctgggactggggtgaactctcattcagcctgtttctccatctctctttcgtctcgaaactcattctcatgcccacagttattggggcataaagattccttaaatggcttcctccagagaaaaatacgtttaaggcacttccttagtggtttgagccctgggcgagcccctcctccactccgtttattttccactatgtatttaaatcttccccgatggtgcctgtcttctcgtcactaaggctgactttctgtttttggggtgaaacctgtgtctccttcaacctccagtcactcagtggattttttttttttagattcataacatattttattttgacttatctaactgatgtcaaaaatggaaaatgttcacatggatattcatctaactcatgggctccattctaaaaaccccctttttaaaaatcaggcttcagtgtcagattgctgaatgtttttttcattttcctgagagatgcaaatgttcattcattcatctcattatacaacacagtacataaatgtagcttcagagcgtattaagtgcttttatacacaagtgctggctgtgtggaccaggtggtagctcatttaggccccaaattcattaagggcagggtctgactcttaggcttcttaatatttggtttggtgcatggtcaagagctggacccacatgttgcatagcagcagggctgatatgtttaaagacgctgggctttttctgctctggggccctttcccgggggttccggtgagtccctccccaggtgggtctgcccccacccgtgtgggcgggattagctcccagaggctggccaggccccacctgggggaggcttgagggcagggccccaaggctgagattcaggcttgggggaacagagcaggaaagagacccggtaccgaaagtgagcggggcaggcacctagtcacatgggtaatgggcaggggtcggtcactggctttggctccagggccagagcagtctgacttagtgttgagctccaagcatggaacactggagttggttcattttgaccagcaagcctctaaatgggtgccttgattacccaccgcaaggagagggcagttgcctttttatgacatgttaattccagccaggtgagtcaccaggtagctctcatcctcctgccaggctcccctgcctgtcggtttggcattgtcagataatgtgatcattcattgaagtgacatttgagttccaaaccagttttctcctttaaccatttcaccctcaggagtgattctcctttgtttggcattgtcagggaatgtgatgatccattcaaatgacttttgagttccaaatagtgtttctactttaacttcctaaatgaaaaaaaaaaaaaaaaaaattggc

SEQ ID NO: 9499 - DNA, 1399 bp, Homo sapiens; identical to SEQ ID NO: 9498

SEQ ID NO: 9500 - DNA, 345 bp, Homo sapiens
atataagggttcctgttattctcttgtcacttagatgtgattttatttcttgggaacatcctactgccttttcttcaaaagattctcctcttctgctggccttgaactaagtccagtctacctgctggcctgaggtggcgggggtgtgtgtgtcagccccctcagttgtgttcctggggcaggcagaactcaccagcacccggtgctgattttatcccttccttctctgaaaactcggagagtatgtgccagctgctgtctgcgattgatgcacatttattttgtcacttgggctcagaacgtcctcaccagtgagcagcttctgattaatgccgccaccccatc

SEQ ID NO: 9501 - DNA, 345 bp, Homo sapiens; identical to SEQ ID NO: 9500

SEQ ID NO: 9502 - DNA, 6976 bp, Homo sapiens
  misc_feature (3836)..(3836): n equals a,t,g, or c
tgaattaaaaggaggggtgaaagtggatgatgtttctaaatattattcacatatactgaaggtcaagattgggggataaagaaagtaggcctgggaaagtaataataaaatatgcctaagactccaagctacaacttttagtgcgaagactttaggagtgggttttagaatattctggccaagccaggatttagtttcttttctgataccaaagtaactacacgggacatggcaaccaccaagggtctttgcagcaggatgacttcgcctttatatgaaggacttggaaatcactgctttaaaaggaacattagagaggtgacttacagtaattgttttttatttcactctttttttctcctttgacactgtctcgttcttgagttttttaaatgcttgtgaattttctttgcttctagttctgaattcctacttgatatggtcaaggctaattttaggactccttgaggtaaaaaaaaaataatacatttttacattgtaaagtattaaatattttacctctattcctattgacatgcctacatgcatatttaaccatatcagaacaacttaagttttcataaagctatcttttgtgtaggacaagtatatcaaagaagcacatctcagaatttttacttgtaattatttcataattcttactgctggaatatttttctcagttttctcctttttattaaaccaagttaaaagatagttgaaatttgaaattatactattttcctgttgttgtcttctcagaggaacatcttgagggcccagtttatctgtagttcatactagatacttgctgatagtgtcattgtagatgtcttcaccttatctatccaatgttcttgtagaatatatcagctgcagctctttcctccccaaataacaaacataaacccttaaacaccgaaattttgtttcaccaaaacttttcaaaaagattataatactattctagaacttgaaatcatattctctgctcttaaaaatatataaaatacaataataaggacccaggattgttaggaaatcagttatgtgccactggattatatagcagtttttgtgccttctctcctgtgttggcagcagccattgcagttttcacaatgccttcctcctctgctcctaatataccagagactaaaataaaataatggaaatgttactaatacattaaccaatatgctttgaatatggtctagggccatgtaaattttcttgcacttaggctctaaaaccttgttttcttttttgtgtgttccagactgtcttccatgttagggaatcgtctggtttaacattaaataaaatgttaatctgttgtctgttgtcaagatttgagttgataatttgtttacctttcttcagggaagaactgctaaagctttgaggtcattacaatttacgaatccaggaaggcaaactgaatttgctccagaaactggtaaaagagaaaaaagaaggcttacaaaaaatgcaaccgctggttcagacaggtaggctaagtgttactgaagacatgttaacttgctgcttcacatctgcattgttcccctatttttctcttaaattttgaattttctgggttcatattttaaattggataatgtagaattagtaaaaacctatgaaggcctttgtttttattcatataaaattaaggtatccctttcaactacaaaaatttgtttctaagaaggtagcagtgaactgaagaaataattttggcatgagagttaaaataattacaattaaagtaattcacttatttgaaaagcattgttattatatatatacggacatacctcattttattggtgcttcactttattctttacaaggtgctatttatttttacaaattgaaaatttgtggcaactcggtggtaagcaagtctattggtgtcatttttctaacagcatgtactccctatctctgtcgcattttggtaattattgcaatatttccagctttttcattactgtatctgttatgatgatctttgatgttactattataattattttgagtcactaggaaccacactaatgcaaggtggtgaacttagtcgataaatgctgtgggtgttcttactgctccacctactggctgttctctagactctctccctctcctcaggtgtccctattccctgagaaacaaatatattgaaattggtccaactaataaccctgcaatggtctctaagtgttcaagtgaaaggaagagtcaagtttctcattttacaaaaaaagctagaaatgattaagcttgggagtaaggcacgtcaaaagctgagacaggccaaaagctgggcctcttgtgctaaacagccaagttgtgaatgcaaagaaaaagttcaggaaggacattaaaagtaccattccattgaacacaaatgataagaaagcaaaacagccttattgctaatatggagaaactttaaatggtctggatagaagatcaaaccagctacaacacattcccttaagcaaaagcctaatccaaagcaaggttctaaccctcttcaattctctgaaggatgagagaagtgaggaagcttcagaagaaaagtttgaagctagcagaggttggtttatgagggtaaggaaagaagccatctccataacataaaagtgcaaggtgaagcagcaagttattaatgaaggtagctacactacccaacagattttcaatgtagaccagccttctttttttttttttttttttttttttgagatggagtcttgctctgtcacccagcctgaggtgcagtggcgcaaactcagctcactacacccgccacctgctgcgttcaagcgattcttctgcctcaacctcttgggtagctgggactacaggcacgtgccaccacagccagctaattttttgtatttttagtagagacgggtttcaccatgttagccaggatggtctcgatctcctgccctcgtgatctgcccaccttggcctcccaaagtgctgggattacaggtgtgagccaccacgcccagccaacaaacagccttctaatggaagaagatgccgtctttcatagctagagaggggaagtctatacctggcttcaaatcttcaaaggacaggccgtttctcttggtagggacgaatgcagctggtgacttttaagttgaagccaattatttacctcttcgaaatcctagggtcctaatgatgctaaatgtactctacctgtcctgtataaatgggacaaagcctgaatggcagcatatctgtttacagcattgttcattgaatattttaagcccacttgagagacctcctgcctagataaaaggattcctttcaaaatattgctactcattgacaatgtacctgatcactcaggagctctgatagagatgtcccaggagataaatgtttcatgcctcctaacacaacattcattctgtagcccacggatcaaggagtactttgactttcaagtctgttatttaagaaatacgttttgtgaggccagagctgccatagacagtgagtgattcctctgatggatttgggcaaagtaaattgaacaccttctggaaaggattcaccattccaagagtttggaagaagattcgagtcctcatggatgactttgaggggttcaggacttcagtggaggaagtagttgcagacgtggtggaaatagcaagagaactagaattagaagcagagcctggagatgtgactgagttattgcaatcttgtgataaaacttgaatggataaggagtttcttcttagagatgagcaaagaatgtgatttattaaggtggaatctactggtgaggatgctgntaacattactgaaatgacaaaggacttagattatataaacttagtagataaagcagaggcagaatttgacaggatgactccaattttgaacattctactgtaggtaaaatgctatcaaacaccatcacatgctacagagaaatcttttgtaagaagagtccactgatgcagcaaacttcactgtagtctttaagaaattgccacagctaccctagccttcagcaacgacctccctgatcagtcagctgtcctcactggggcaagatcctccaccagcaaaaaaactacaactcattgaagtttcagatcattgttagcattttttagcaatagagcatttttaaattaaggtacatacatttttttcttagacataaggctgttgcacacttaataggctatagtgtaagcttaacttttatatgcactggaaaagcaaaaaaatatatatatatatatgtgtgtgtgtgtgtgtgtgtgtgactcactttattgggggtggtctggaaccaaacccacaatacctccgaaatgtgcctgtaattcatatatctccgttctatgggtagcagctaaaaggtaattacattttatgagaatgcaaggtttttattttttacatgtctgaaatagaaatgcagttctgtatagtcaacataatgaatgggagaactaaattgtttagaatatgactctaaaacaaatgttaatataatcattcagaattttttttctaagttcagtcaacatttctatatatgccatgtattccatctgttaaaatttaccattgagtcatttaaatatttttaggccaaatttactagagtccattaaagaacaagaaacattaattgtagtataaaaatctatagaggtggtatactataataaaaataaaactgtgttgataaaacagtgaagaggttggtagctaataaagtgaaccactattaacctgtcattcttttttgtttgtttaaagtaaagggaaaattatgcacttcaagaagcgtattcagaatttttagatttgtctcaacactctatagagttaggtctcctcttctcacatggagttcatttactgctgacgatagaataagccttgagcctgataaattatagatgattttggcatgacctcatctaaaaatattttatctccttttttttttttactgtattttcaattaaatcaaaaataacatatttatgaggtataattcattgtgttttattttacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcatgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttatcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattgattgca

SEQ ID NO: 9503 - DNA, 1288 bp, Homo sapiens
ttttattttacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgttttt

SEQ ID NO: 9504 - DNA, 7573 bp, Homo sapiens
agggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatgtatgtgtaatagtcatttttttctacattgtgaattctaccatgtaggattttgcttaactataagaaaatcatatttacattattactaaatttgttagcatacagtgaattaaaaggaggggtgaaagtggatgatgtttctaaatattattcacatatactgaaggtcaagattgggggataaagaaagtaggcctgggaaagtaataataaaatatgcctaagactccaagctacaacttttagtgcgaagactttaggagtgggttttagaatattctggccaagccaggatttagtttcttttctgataccaaagtaactacacgggacatggcaaccaccaagggtctttgcagcaggatgacttcgcctttatatgaaggacttggaaatcactgctttaaaaggaacattagagaggtgacttacagtaattgttttttatttcactctttttttctcctttgacactgtctcgttcttgagttttttaaatgcttgtgaattttctttgcttctagttctgaattcctacttgatatggtcaaggctaattttaggactccttgaggtaaaaaaaaaataatacatttttacattgtaaagtattaaatattttacctctattcctattgacatgcctacatgcatatttaaccatatcagaacaacttaagttttcataaagctatcttttgtgtaggacaagtatatcaaagaagcacatctcagaatttttacttgtaattatttcataattcttactgctggaatatttttctcagttttctccttttcattaaaccaagttaaaagatagttgaaatttgaaattatactattttcctgttgttgtcttctcagaggaacatcttgagggcccagtttatctgtagttcatactagatacttgctgatagtgtcattgtagatgtcttcaccttatctatccaatgttcttgtagaatatatcagctgcagctctttcctccccaaataacaaacataaacccttaaacaccgaaattttgtttcaccaaaacttttcaaaaagattataatactattctagaacttgaaatcatattctctgctcttaaaaatatataaaatacaataataaggacccaggattgttaggaaatcagttatgtgccactggattatatagcagtttttgtgccttctctcctgtgttggcagcagccattgcagttttcacaatgccttcctcctctgctcctaatataccagagactaaaataaaataatggaaatgttactaatacattaaccaatatgctttgaatatggtctagggccatgtaaattttcttgcacttaggctctaaaaccttgttttcttttttgtgtgttccagactgtcttccatgttagggaatcgtctggtttaacattaaataaaatgttaatctgttgtctgttgtcaagatttgagttgataatttgtttacctttcttcagggaagaactgctaaagctttgaggtcattacaatttacgaatccaggaaggcaaactgaatttgctccagaaactggtaaaagagaaaaaagaaggcttacaaaaaatgcaaccgctggttcagacaggtaggctaagtgttactgaagacatgttaacttgctgcttcacatctgcattgttcccctatttttctcttaaattttgaattttctgggttcatattttaaattggataatgtagaattagtaaaaacctatgaaggcctttgtttttattcatataaaattaaggtatccctttcaactacaaaaatttgtttctaagaaggtagcagtgaactgaagaaataattttggcatgagagttaaaataattacaattaaagtaattcacttatttgaaaagcattgttattatatatatacggacatacctcattttattggtgcttcactttattctttacaaggtgctatttatttttacaaattgaaaatttgtggcaactcggtggtaagcaagtctattggtgtcatttttctaacagcatgtactccctatctctgtcgcattttggtaattattgcaatatttccagctttttcattactgtatctgttatgatgatctttgatgttactattataattattttgagtcactaggaaccacactaatgcaaggtggtgaacttagtcgataaatgctgtgggtgttcttactgctccacctactggctgttctctagactctctccctctcctcaggtgtccctattccctgagaaacaaatatattgaaattggtccaactaataaccctgcaatggtctctaagtgttcaagtgaaaggaagagtcaagtttctcattttacaaaaaaagctagaaatgattaagcttgggagtaaggcacgtcaaaagctgagacaggccaaaagctgggcctcttgtgctaaacagccaagttgtgaatgcaaagaaaaagttcaggaaggacattaaaagtaccattccattgaacacaaatgataagaaagcaaaacagccttattgctaatatggagaaactttaaatggtctggatagaagatcaaaccagctacaacacattcccttaagcaaaagcctaatccaaagcaaggttctaaccctcttcaattctctgaaggatgagagaagtgaggaagcttcagaagaaaagtttgaagctagcagaggttggtttatgagggtaaggaaagaagccatctccataacataaaagtgcaaggtgaagcagcaagttattaatgaaggtagctacactacccaacagattttcaatgtagaccagccttctttttttttttttttttttttttttgagatggagtcttgctctgtcacccagcctgaggtgcagtggcgcaaactcagctcactacacccgccacctgctgcgttcaagcgattcttctgcctcaacctcttgggtagctgggactacaggcacgtgccaccacagccagctaattttttgtatttttagtagagacgggtttcaccatgttagccaggatggtctcgatctcctgccctcgtgatctgcccaccttggcctcccaaagtgctgggattacaggtgtgagccaccacgcccggccaacaaacagccttctaatggaagaagatgccgtctttcatagctagagaggggaagtctatacctggcttcaaatcttcaaaggacaggccgtttctcttggtagggacgaatgcagctggtgacttttaagttgaagccaattatttacctcttcgaaatcctagggtcctaatgatgctaaatgtactctacctgtcctgtataaatgggacaaagcctgaatggcagcatatctgtttacagcattgttcattgaatattttaagcccacttgagagacctcctgcctagataaaaggattcctttcaaaatattgctactcattgacaatgtacctgatcactcaggagctctgatagagatgtcccaggagataaatgtttcatgcctcctaacacaacattcattctgtagcccacggatcaaggagtactttgactttcaagtctgttatttaagaaatacgttttgtgaggccagagctgccatagacagtgagtgattcctctgatggatttgggcaaagtaaattgaacaccttctggaaaggattcaccattccaagagtttggaagaagattcgagtcctcatggatgactttgaggggttcaggacttcagtggaggaagtagttgcagacgtggtggaaatagcaagagaactagaattagaagcagagcctggagatgtgactgagttattgcaatcttgtgataaaacttgaatggataaggagtttcttcttagagatgagcaaagaatgtgatttattaaggtggaatctactggtgaggatgctgttaacattactgaaatgacaaaggacttagattatataaacttagtagataaagcagaggcagaatttgagaggatgactccaattttgaacattctactgtaggtaaaatgctatcaaacaccatcacatgctacagagaaatcttttgtaagaagagtccactgatgcagcaaacttcactgtagtctttaagaaattgccacagctaccctagccttcagcaacgacctccctgatcagtcagctgtcctcactggggcaagatcctccaccagcaaaaaaactacaactcattgaagtttcagatcattgttagcattttttagcaatagagcatttttaaattaaggtacatacatttttttcttagacataaggctgttgcacacttaataggctatagtgtaagcttaacttttatatgcactggaaaagcaaaaaaatatatatatatatgtgtgtgtgtgtgtgtgtgtgtgactcactttattgggggtggtctggaaccaaacccacaatacctccgaaatgtgcctgtaattcatatatctccgttctatgggtagcagctaaaaggtaattacattttatgagaatgcaaggtttttattttttacatgtctgaaatagaaatgcagttctgtatagtcaacataatgaatgggagaactaaattgtttagaatatgactctaaaacaaatgttaatataatcattcagaattttttttctaagttcagtcaacatttctatatatgccatgtattccatctgttaaaatttaccattgagtcatttaaatatttttaggccaaatttactagagtccattaaagaacaagaaacattaattgtagtataaaaatctatagaggtggtatactataataaaaataaaactgtgttgataaaacagtgaagaggttggtagctaataaagtgaaccactattaacctgtcattcttttttgtttgtttaaagtaaagggaaaattatgcacttcaagaagcgtattcagaatttttagatttgtctcaacactctatagagttaggtctcctcttctcacatggagttcatttactgctgacgatagaataagccttgagcctgataaattatagatgattttggcatgacctcatctaaaaatattttatctccttttttttttttactgtattttcaattaaatcaaaaataacatatttatgaggtataattcattgtgttttattttacagacaagtgataccagcaaagagtaaggtctatgatagccagggtctcctgatttttagtgggatggacctctgtgactgcctggatgaaactgcttagatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattgattgca

SEQ ID NO: 9505 - DNA, 2468 bp, Homo sapiens
caggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtagtcctagctgctcagggggtgaggcgggaggatcacttgactcctgggttacagtgagctctaattgccactgcacttcagcctgggccacagagtgagaccttttctcaaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattatctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaa

SEQ ID NO: 9506 - DNA, 15212 bp, Homo sapiens
gatgatgagagtaatgttgcagttaccagacccgattcagaaagttcctgtgtgctgagtgaactacatcctttggtgttaccgcgagtgccacagtctaaggtgctgtacattacctcaaatccggtaagccccagagggatcagttggagaccccagggctactctcaccagaggaaatttgctcagagttgtttgccttacttgtatgatttctgactcaatatgttttagtacagttatgtgtttatcataataatccagtgactcttcgcattggtttgtttaaaatattaatagcaaattagagttgataaatatttctcagtcagctcttctaaggaggcatctgtaagttgtgcaacctagaatcaaccatgtggtcagcctaagtctgttttgggaagaatggaggatacccttatgataaaaatgactcatcttagattctctatggccttgacattgtcctttgaacgcctccttccttttgagtttttccttcctttttctctcaacttggcccaccctgtttattttttattttttcattttttttgagacagtctcgctctgtcacccaggctggagcgcagtggcatgatctcggctcactgcaacctccgcctcccaggttcaaccagttcttgtgcctcagccccctgagtacctgggattacagatgtgcaccaccactcggctgatttctgtatttttggtagagacagagtttcaccatgttggccaggcccgtctcgaactcctggcctcatgtgatccacctgcctcaggctcccaaagtgctggaattacaggcatgagccaccaccgcacctggtccctgtttgttttttagagagaggagtctcactatgttgcccaggctggtctcaaactcctgggctcaagccaccttcccacctcagcctcctgagtcgccaccatacccaggctgtttttgttttttaatatttaaatctgttaacttttttgccttttggatgtttagtactcataaaccaggtataaaaatcaaacaaaaacaaagagaaaagctatttcaagtgagtctgaacaagcacaaagatggtatttcttgcaggaggcagatgagattggtcttatccctgtgtaatgatttatgtagtctcagttcctacacaatagtttcctggtgttacttttaaggtggaaaaaaaaaaccagagaaaggtgttggcatattggccagatgttatacagctggatttacaaaacaggtatttaaaaagaaaattaggccaaggtgggtgggtcatttgaggccaggagttcaagaccagcctggccaatttggtgaaacctcatctatactaaaaatacaaaaactagctgggcatggtggcaggcacctgtagtgccagctactctggaggctgaggcaggagaatcacttgaacctgggaggcagaggtagcagtgggctgagattacgccactgcactccaacctgggtgacagagcaagactccgtctcagaaaaaataagagaaaattatgaaggctcgtaagtcaccacaccagggatgaaccaggtaaattaatgttccttttgtggtagtaaagcactgctgcatgttgaactggtgtggccgtggtttagtgacctaagccctgaatagttagacgttctggtcgctgatgacctaagaaaggagaagagttaattcaaacattctgaagagaaagaggaaggaaaatacattctgtggcagcggagactgccagaaaagccaatgagctgatgacctgagaaaacaagcagggctctaggggggcaatgccagtccaagaaacattacatcctgctaaaattagaacagataagcttacctcctagtacagagtcttcaggatttaggttatcattgagggctgacctgctccacaggtagtgaaagagaaggattagtttgtacagagtgcaggattgtgtgatgatgaaagagattaagttacagtttccccttactattttctattattgttccatattttgtctgtgagttttctcttctattttaatgtaaacaataataataaaggtcctcactccctgtaagagggctgttaattgttttcatccagattgatcaggcttcccctacctgctgtcatttaggaatggagaggaaaggagggaccctatcacatggacagttgacttggggccccagctacgggccccaagatgttataaaaattaaagcatggggaaaaagtataaataaccaaattggaaatattaacttttggcaaagttggaaaaccaaacaggtatcttctccaaccgatcaagagtactgtcttctttcaacacgtagatgagtctctgtcaagcaagcagacatcagccaaatgtgaatgatctcttggttcatggaatgcctctacagccaagaaatctctccctaatggacaagctcctgtaagaagttcaacattttcagactatacagtgtaaaagggaaacagagggaaagcaaaatcagtttatcagtatgcatgtattgagtgccaaccaagcaaccacaaaaactcctggggagtaaaacatccaagggacatggtctccaccatcagggggctgataatgtaactggaaagagaagacatacgtgggtaaaaaaagacctaaccatatgtggcatttttgtaactgagtgccatgtgcgtgctgtccagaatgagtgctatgacagccccaaagcattctggtgggtaagtgtaggttttgaacttgtccttgaaagatggggctttggataagcaaaggagagcagcaagggcattctaggtaggaggaatgatatggggaaaggtttggggataagaaaatacaaaatatttaggaaagatagcagatcacttttgacatagaagaacggaaaataggtcagaactttaatgcttctgatcaaagataattgacaatcttctagaattaaaatagaccatggtgtgattagcgggaaagaagtgactatggaactaatgaatgttaggaccagattgtggagagttttgagtgtcaggtttttgggattcatccacgttgttgtgtatgacctcctcccttgctgaggagtattctattgtaatacacacaatttatccatctgctctcctgttaattaattaacaagggtcatttccaggttagaggtattacacataataaagttactctaaatattcttgtataggtcttttttgtggttttacggtctcatttctcttgagttgatacctagaaatgaaagggtcatagcacaggtatatgtttagtttcataggaaactgccatacgatttcccaaaggagttgtaccattttacactccttccagcaatgtatgaattttggtttgggagcacatatatttaaatcaggaatctgaaagatcgatttcaccatagtgtaaatggatggagtggaaggaactgaaggtaaggggtcaatgcaggagtccacgcatgagctactaagggtctgcactcaagcggccacacagggtgagaaacgaatgagctattttgggagtgaaatttaagtgaaattctatagaaatagaggaatcaaagttatctcgatttcaagcttgagggaagcctctgttggcggaaaagatgggtttcttctggggtgtgtttacagtgaggggccatctcactggcaatgtggaagaggtcggatctagagaccaatctaaaagtcacctggctagagaagacaatcaaatccagaagttcatagaacaaaataaaggtgaacatagggcagctaaagcctaaacattttgtaattagaaagcagttagggtgtgttaaaaaaaaaaaaaaggcataagtgaattgctagagaggcaggaagaccagaacagtctccaggtttagccctgttccttgatgggcagcatcccttcaaagtcctccaagcacggtgccatgttttgcactagaggacaccaaagtggcctgaaaggttgaggaacttgctgaaagctataggagcaaatggcagagcttagctgcgttattctttcacttctcttccatttaattgtgcggatactcttagatgtcttaaaatagtcaaatgtcctctcacttgctttaaaagaaaaaaaaatacacacctgaatctgtagggcagtatttaagctactgaactgtttaggtgtggtattattttatttattggacgacttacagaaaagggttgtatttcagttatttatgcaaatagggctactgtggtcccaacagctctggctctgggcagcacaagaccctttgcccactcccagctttccaaagaacccaaacccaaatccctgccagctccaacttgctcagcactttaattgctacagtgggagccacactggtgccacaactgctcccaagcagcaatatttgtctttcagttgtctttctggtgacaatctttcagcacaaaagaatgcctcaaacagagtaggaatcagcccctgtggcaaatttttgggaagcactttggagtaggtgtccttcaggcttgccttcactggtgactaaaaaagtgactgtgatggcaggtggataatggacttgctttgccaaatgtccattctagtaaattatgtttatgattgaaataatgtcccacttttaagaacagattctcatgcctgagctagagtaccatctggaaactagtgttacttattgaaaggtttttatttttgctttatttccccctaaatgtagtttctagtctaaggctttttaccccgttagtcttgtcttccttgacatactgatctttacttcattgtgggtttctgatttggctactagagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtgtaggtttcaaaagcagaacttctggaaaccgtggtaaaactaacacattttacatacagaattaatttaaatataagactgaaatctatgcctagaaactaatcattaagtagtcttatgacagattgcccatgggtttagatccaacacaaaattttttaatgtggttaaattttattttattttatttttttagatacagtctcactcctgtcgcccaggctggagtgcagtggatgatcatggctcactgcagcctcaacttctgggctcaagtggttctcccaccccagcctctcaagtagccgggaccacaggcgggtggtgccaccatgccaggttaactttttgtgtttttagtagagacaggggtcttgtcatgttgcccaggctggtttcaaattcctgagctcaagcaatctgcctgcctcagtctcctaaagtgctgagattacaggtgtgaaccaccgcacccagcaggggttaaataattttaatgaaatagatattgaatctttctgttgatctagctaaagagttctatttgtaaaaataaaatgttggctagaatactatattggggttacaaaaggaataaagaacctatttatttaatcaaacattttccgtgctgggaacatattcagtgaaattcactccaaaataatagttaattcccctttaaggttcttctgtaccattgggatctgcttattccattgacaatgaaaacttcataaacctcagataagtagttgcttacataccagcaaaaatatcccttagcacttcctaggaagtgacactaaaagtaatcgcctttcccacccttcattcactacacactctgagcctcatcatgcaaaaatacctaggagccaattttaaacatagaattcttttagctgttgattcacaaaatgtcttaggatgattaatttctaaaaatatcctcaaaggtatgagataataaggccacagcagtgttttcaatgcggcttccaagttaagcattattatgtggatgtagctatatctataccaacagagctataaatgcattcatttggggatgagtagtcttgatgtataattaatctctcattccttctgacagtactttttttcaaagttgaaaagtaagttgctttgttacttctgggacatgaaagtatcattcagtttcaattactgtcttaaggataaggaatactgcaagctgctccagatcctactgaagggaatgaaggtttaggaactttacccgagaactatagttattagggaaaacgataaccagaaggtccagaactgtcaagaattccatcatcagctgggaatttacaaatccaaatcagcagagaagtgcaataccagatagggacaaatgttttattccagttctgtgggagagaaaaggccagcttctgttgtgtacccagagtatagagcttcaaaacaaaatcagaaaacactattttaaaaactaattttccaaaaatcctgagatctctacttgaaaacataggtagcctaaagctttctgtgcacattaaactcatctgcttcatttatctgatttctaatcaatttgctggtattgttataacttcatgctttcataccttcgtgtttgttggtgggatctgcagcccagtggcacccgactcgctctcctctccctcaccgacgcccctgagtcgaaataatctgctaccacctattggcacagctgaagtggaacatgtgagcactgtggggccacaaagacagatggtatgtttctttcatattgcctctccatgtacttaccatacaacctaatgggcagtaattctgcaggatctgtgccctgatcttgatttatactgtgttttgtcaaaagtacaaacacagtgctaatttatgacgtggaattggagctgtttggcctgcacttaccatatctgccatggtcgatagggttttaactacataccacattacagatagttttcactgtttctgtaacttttgtctcctctgcagaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaactagtccctgatgcctattctttaatgccttatacagaaatcacaaatattctaagcaatttaacacttaagatatgtctgaccacaagcaagaatattaaatcccagtacacatcagataagcataactttattatgtaatcctgttcttctggaattacatcaaaagtggtctcagattatgatgagtcctggtggatgagtgagttgggactttaataaaaaatttttttcagaagcaggctcttgccatgttgcccagactagacctggaactcctgggctcaagcaatcctgccttagcctcccgagtagctgggactacaggtgcacaccactgtacccagcttaggactttttctttctactggtgttttaaatgctgacactgcctaccatttattaggcatttactagcccttttaagtaatagaaaaaacctgatcagcaatggggtcatgcactgaccctccccatttgtaggctgggagctcgaccccacataatctgctttgtggcaagagcacttggagagcctggggaagtaaccagggaccccacatcctgacagttttcaggatggtagtgtttgcagcacacttgtcccaactcatgacccttgaaccacagcaggctaaagcactgcaaagtttttcttctatgagaagagtggtaaggataatcaatatcagacctctgtattagtttcctagggcttaagaaatgaccaaacaactgggtgccttaaaacagcagaaattttttcctcacagttccagaggcgagaagttcaaaatcaaggtgtcaacagagctatgctccctttgcaaggtctagggaagaatctttttgtctcttcctggattctggtggccacctgtgatccctggtgttccttggcttgcagctgcatcactcccaatttctgccttttttttttttttttttgagacggagtctcgctctgtcacctagggtggagtgtaatggcgcaatctcagctcactgcaacctctgcctactgggttcatgtgattctcctgcctcagcctcccgaatagctgggactacaggtgcctgccaccacgcccagctaatttttgtaattttactagagatggggttttgccatcttggccaggctggtctcgaactcctgacctcattatctgcccacctcagcctcccaaagtgctgtgattataggtgtgagccactgtacccggccttttttttcttttctttttttttttttttaagacagggtctcactctgttgcccaggctggagtgcagagcacagctcactgcagcctcaacctcctgggcttaagtgatcatctcacctcagcctcctgagtagctgggactacaggcacatgccaccatgccctgctaatttttttattttgtagagatagggtgtcactatgttggccagactggtctcaaactccgaggttcaagtgatcctcccacctcagcctcccaaagtgctgggactacaggcatgagccacatgcccagcctgcctctgtctttacatggctttcctccctgtgtgtctgtgtccagggttccctcttcttataagataccagtcgctgaatttagggcccaccctaatctagtgcgactttaccttaacttgatttatctgcaaagaccctatttccaaacttggtcacattcacaagttccaggtggacataaattttgagggaacactgttcattctagtagaccccacgaggctgacttagggagaaactcaccaaaaacaagaaaaggaaacatgagcatttctgattcttggggttcagtgtgaaccccagaaagtttgagaacttctactgaatttgccttcttataatctgacacaggacatttattaagtagtacttgatgattatattacacagctagattctctgaaactttttttttttttgagacggagtcttactctgtcgcccaggctagagtgctgtggtgcaatctcagctcactgcagcctccacctcctcctgggttcaatcgattctcctgcctcagcctcctgagtagctgggactacaggcacctgccaccatgcccagctaatttttgtattcttttagtaaagacagtgtttctccaagttgcccaggctggtcttgaacttctgaccccaagtgatccacctaccttggcctcccaaagtgctgggattacaggcgtgagccaccgctctcagccaaacatttcattttttttaagagacaaagtatctcgctacatcacccaggctggagtgtagtggtgcaatcagcacactgcagcctcaaactcctgggctcaagtgatcctcccaccgcagcctcccaagtagctgggattacaggtgtgcacctctgcacctggctaaaaacatttaatttttgattgccttaggaataaaactgaacagatgaaaatgtttcagtcttctctttaagtttattaaaaaaaaagtaaaaattacttaccatttctctccccatttgctgtcataaaaagggagatagctagttgtttagtttattaggaatgctagctgtgagccggctgcagtggcttacacctgtaatcccagcattttgggaggctgaggtgggcagatcacctgaagtcaggagtttgagaccagcctggttaacatggtgaaacccgtttctattaaaaatacaagaaaattagccaggcatggtggtgcatgcctgtaatcccagctactcgggaggctaaggcaggagaattgcttgagcccaggaggcagaggttgcagtgagccgagatcgtgccattgcactccaacctgggcgacagagcgagaagactctgtccccccacaaaaaaaagaatgctagctgtcctgggcctggcactacagactagcactttgctccttgctgttttcatctagaataggggccagtaaactacagttcctgggctactcacttggcctaccgccttgttttgtaaataaacttttattggagcagtgccaccaagctcatttatgtgctatctatggctgccttcataccataacagcgaagctgagtaattgcaacaaccaccctatggtccacaaagcctaatataataactatctggccctttgcaaaaaataagtttgctgacccctgatctctaaaatataggggcttcaccagaaaaagcttcctgaaatctcttgatttcagtgctctctcaagggaactactgggggatgtttttattccagaagccccagcaggatgtcatatatagctttatttgatatttgcattttaatattgtagtcgtatctctacattttttaattccttgaggtaactgtgaaatatttgcatttcataatgctaaaaagtaaatgtaaagttaaatttcgatatggtggtaaagtcataagtatttcaatgttgctgaaaaggctggttgttttaaatgaaagcattcatttaaaatatatgcagcagccaacaaaaagaaatgagacgaacccccttagaactaactgaaatattaaaccatatggattatttataactcctgatttccttaacggcatagtaataatattgaagaatctgcaatttttacaataaatggctttgtgggcatctggcttgggattttctacttgaaattcaacccagtgcactcagctgacttttccctcaagttggtagtctatgccttttaccactgttgatttcaaggtgttcctgtgaacctgctaaaatattatcctttgtgagaagatgcatcataagaagtgtctcctcttttgtcttgtagctggatacacagtatcgtcgctcatgtgcagttgagtatcctcatcaggcccgacctggcaggggatctgcaggtaaaggtggggccatggcccttatttactactgtgtggttgtgttaagacccagcctttgtcttttttcctacacctatttccccttctttcagattttcttggatttaatgttttcccacatctttgtaaatcacctaaaattcattttggaacatggggtataataaaaagctaggagagttctattgctcagagccaaaaagtttcagattcctattttcttcataccatgtaaattaacttctcactactttggtaaactgccttttttttttttttaaatctaaaaagttcaacccaaattagtccttgttgtaatgttcaaaatattctttaagaacatagcatggattttattatgcaggcaaaatccatattcctatggattaaactgctttgatcagttaatctgttaggccaaggtaagaaaagaaattctaaaccatcaggatatgctgagtctgattctatcgcattaactctttttatctttaaattatactctgtagatgtactaacaaagaagtgatgggagaaaattgagggatgtcttttttgagacagtctcactctgctgatcaggccagaatgcagtggcatgatcatggctcactgtagcctcgaactccggggctcaagggatcctcccacctaagcctcccacatagctagggctacaagcagtgccaccatgcccaggtaatttattttttgtagagacagggtcttgctatgttgcccaggctgcaggatgtcttaattcttcctgtgacagtcttctcaccaccatcagggtcattcttattatgctgaaggtaaatttagaagtaatggacagctgagatgtttcctgttaatgatcaaaataatcagcaactatggtaaaaaactagtctgcctcaaaccatctttgtagtccaagtgatttctcagctcagttccccgcagcattgtctggtagtctttgaatgcttttgtcagattatgctttcagatctgcatttgagctacaatttcagccacattgaaagtcaggtataactggctgggcgtggtggctcatgcctgtaatcccagcactttcggaggccaaggcgggcggatcacgaggtcagcatattgagaccatcctggctaacatggtgaaaccccatctctactaaaaatacaaaaaattagccgggtgtggtggcagatgcctgtagtcccagctactcgggggactgaggcaggagaatgaggtgaacctggaaggcagagcttgcagtgagccgagatcatgccactgcacctccagcctggggggacagagtgagactccacctccaaaaaaaaaaaaaaacctcaggtataacttatgtaacactgaagtggaagtgagtaaatcagacatcttgcttctttttaattagtgggctcttctacaaaactagtttactgctttcataccttaagaaagtccaattcataattggagcaaaaaagcccttagctataaacttgagagtgattatcaaacctagactgtctactaatgttactctatgtcatctgacaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaataaagagaggatctattcaagatcattaagcccaaatgtaatctgggaagtatgtggaagatagctgtccagcaagtgtctgaaaggtgttctagctgggtagagagcatattctaacagtcatgcacatcgcagaaagcagcatgaacagatcctcatcttagataagagttgtgtgtacaaaagatccatgaaggcaagtcttgtcaggaaggatagtgcctccttccaccttcgtaaatgtcaccacaaggttctgtcaggtgagacctcacacaatgtcaagtgctttgtaggaaatgctaagatcaggttgagagattctggttggtttagcaaat

SEQ ID NO: 9507 - DNA, 5188 bp, Homo sapiens
aaaaattaaagcatggggaaaaagtataaataaccaaattggaaatattaacttttggcaaagttggaaaaccaaacaggtatcttctccaaccgatcaagagtactgtcttctttcaacacgtagatgagtctctgtcaagcaagcagacatcagccaaatgtgaatgatctcttggttcatggaatgcctctacagccaagaaatctctccctaatggacaagctcctgtaagaagttcaacattttcagactatacagtgtaaaagggaaacagagggaaagcaaaatcagtttatcagtatgcatgtattgagtgccaaccaagcaaccacaaaaactcctggggagtaaaacatccaagggacatggtctccaccatcagggggctgataatgtaactggaaagagaagacatacgtgggtaaaaaaagacctaaccatatgtggcatttttgtaactgagtgccatgtgcgtgctgtccagaatgagtgctatgacagccccaaagcattctggtgggtaagtgtaggttttgaacttgtccttgaaagatggggctttggataagcaaaggagagcagcaagggcattctaggtaggaggaatgatatggggaaaggtttggggataagaaaatacaaaatatttaggaaagatagcagatcacttttgacatagaagaacggaaaataggtcagaactttaatgcttctgatcaaagataattgacaatcttctagaattaaaatagaccatggtgtgattagcgggaaagaagtgactatggaactaatgaatgttaggaccagattgtggagagttttgagtgtcaggtttttgggattcatccacgttgttgtgtatgacctcctcccttgctgaggagtattctattgtaatacacacaatttatccatctgctctcctgttaattaattaacaagggtcatttccaggttagaggtattacacataataaagttactctaaatattcttgtataggtcttttttgtggttttacggtctcatttctcttgagttgatacctagaaatgaaagggtcatagcacaggtatatgtttagtttcataggaaactgccatacgatttcccaaaggagttgtaccattttacactccttccagcaatgtatgaattttggtttgggagcacatatatttaaatcaggaatctgaaagatcgatttcaccatagtgtaaatggatggagtggaaggaactgaaggtaaggggtcaatgcaggagtccacgcatgagctactaagggtctgcactcaagcggccacacagggtgagaaacgaatgagctattttgggagtgaaatttaagtgaaattctatagaaatagaggaatcaaagttatctcgatttcaagcttgagggaagcctctgttggcggaaaagatgggtttcttctggggtgtgtttacagtgaggggccatctcactggcaatgtggaagaggtcggatctagagaccaatctaaaagtcacctggctagagaagacaatcaaatccagaagttcatagaacaaaataaaggtgaacatagggcagctaaagcctaaacattttgtaattagaaagcagttagggtgtgttaaaaaaaaaaaaaaggcataagtgaattgctagagaggcaggaagaccagaacagtctccaggtttagccctgttccttgatgggcagcatcccttcaaagtcctccaagcacggtgccatgttttgcactagaggacaccaaagtggcctgaaaggttgaggaacttgctgaaagctataggagcaaatggcagagcttagctgcgttattctttcacttctcttccatttaattgtgcggatactcttagatgtcttaaaatagtcaaatgtcctctcacttgctttaaaagaaaaaaaaatacacacctgaatctgtagggcagtatttaagctactgaactgtttaggtgtggtattattttatttattggacgacttacagaaaagggttgtatttcagttatttatgcaaatagggctactgtggtcccaacagctctggctctgggcagcacaagaccctttgcccactcccagctttccaaagaacccaaacccaaatccctgccagctccaacttgctcagcactttaattgctacagtgggagccacactggtgccacaactgctcccaagcagcaatatttgtctttcagttgtctttctggtgacaatctttcagcacaaaagaatgcctcaaacagagtaggaatcagcccctgtggcaaatttttgggaagcactttggagtaggtgtccttcaggcttgccttcactggtgactaaaaaagtgactgtgatggcaggtggataatggacttgctttgccaaatgtccattctagtaaattatgtttatgattgaaataatgtcccacttttaagaacagattctcatgcctgagctagagtaccatctggaaactagtgttacttattgaaaggtttttatttttgctttatttccccctaaatgtagtttctagtctaaggctttttaccccgttagtcttgtcttccttgacatactgatctttacttcattgtgggtttctgatttggctactagagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtgtaggtttcaaaagcagaacttctggaaaccgtggtaaaactaacacattttacatacagaattaatttaaatataagactgaaatctatgcctagaaactaatcattaagtagtcttatgacagattgcccatgggtttagatccaacacaaaattttttaatgtggttaaattttattttattttatttttttagatacagtctcactcctgtcgcccaggctggagtgcagtggatgatcatggctcactgcagcctcaacttctgggctcaagtggttctcccaccccagcctctcaagtagccgggaccacaggcgggtggtgccaccatgccaggttaactttttgtgtttttagtagagacaggggtcttgtcatgttgcccaggctggtttcaaattcctgagctcaagcaatctgcctgcctcagtctcctaaagtgctgagattacaggtgtgaaccaccgcacccagcaggggttaaataattttaatgaaatagatattgaatctttctgttgatctagctaaagagttctatttgtaaaaataaaatgttggctagaatactatattggggttacaaaaggaataaagaacctatttatttaatcaaacattttccgtgctgggaacatattcagtgaaattcactccaaaataatagttaattcccctttaaggttcttctgtaccattgggatctgcttattccattgacaatgaaaacttcataaacctcagataagtagttgcttacataccagcaaaaatatcccttagcacttcctaggaagtgacactaaaagtaatcgcctttcccacccttcattcactacacactctgagcctcatcatgcaaaaatacctaggagccaattttaaacatagaattcttttagctgttgattcacaaaatgtcttaggatgattaatttctaaaaatatcctcaaaggtatgagataataaggccacagcagtgttttcaatgcggcttccaagttaagcattattatgtggatgtagctatatctataccaacagagctataaatgcattcatttggggatgagtagtcttgatgtataattaatctctcattccttctgacagtactttttttcaaagttgaaaagtaagttgctttgttacttctgggacatgaaagtatcattcagtttcaattactgtcttaaggataaggaatactgcaagctgctccagatcctactgaagggaatgaaggtttaggaactttacccgagaactatagttattagggaaaacgataaccagaaggtccagaactgtcaagaattccatcatcagctgggaatttacaaatccaaatcagcagagaagtgcaataccagatagggacaaatgttttattccagttctgtgggagagaaaaggccagcttctgttgtgtacccagagtatagagcttcaaaacaaaatcagaaaacactattttaaaaactaattttccaaaaatcctgagatctctacttgaaaacataggtagcctaaagctttctgtgcacattaaactcatctgcttcatttatctgatttctaatcaatttgctggtattgttataacttcatgctttcataccttcgtgtttgttggtgggatctgcagcccagtggcacccgactcgctctcctctccctcaccgacgcccctgagtcgaaataatctgctaccacctattggcacagctgaagtggaacatgtgagcactgtggggccacaaagacagatggtatgtttctttcatattgcctctccatgtacttaccatacaacctaatgggcagtaattctgcaggatctgtgccctgatcttgatttatactgtgttttgtcaaaagtacaaacacagtgctaatttatgacgtggaattggagctgtttggcctgcacttaccatatctgccatggtcgatagggttttaactacataccacattacagatagttttcactgtttctgtaacttttgtctcctctgcagaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaa

SEQ ID NO: 9508 - DNA, 349 bp, Homo sapiens
atctgcctcagcctcccacagtgccgggattacagatgtcagccaccatgcccagcctgcttggtcatttgtatggtgtcttgctcttagtcatattttctatttctgcttttgttttacattctacatctgtcaattccaatttctgaagtccttgctgatccgactatgctgtttctgcctgctctttttcaagatgccttgtttcttcgtggatgtgattcttaaaagtgatttctaatctcataactttacctgtgggaattgaggtctggattaatgaaggtttccctagagctatactgtccaatagagtaggcaccagccacgtttggccataagttaaaat

SEQ ID NO: 9509 - DNA, 119 bp, Homo sapiens
aaacaagcagggctctaggggggcaatgccagtccaagaaacattacatcctgctaaaattagaacagataagcttacctcctagtacagagtcttcaggatttaggttatcattgagg

SEQ ID NO: 9510 - DNA, 556 bp, Homo sapiens
gaactcctgggctcaagcaatcctgccttagcctcccgagtagctgggactacaggtgcacaccactgtacccagcttaggactttttctttctactggtgttttaaatgctgacactgcctaccatttattaggcatttactagcccttttaagtaatagaaaaaacctgatcagcaatggggtcatgcactgaccctccccatttgtaggctgggagctcgaccccacataatctgctttgtggcaagagcacttggagagcctggggaagtaaccagggaccccacatcctgacagttttcaggatggtagtgtttgcagcacacttgtcccaactcatgacccttgaaccacagcaggctaaagcactgcaaagtttttcttctatgagaagagtggtaaggataatcaatatcagacctctgtattagtttcctagggcttaagaaatgaccaaacaactgggtgccttaaaacagcagaaattttttcctcacagttccagaggcgagaagttcaaaatcaaggtgtcaacagagctatgctccctttgc

SEQ ID NO: 9511 - DNA, 3371 bp, Homo sapiens
cttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcactttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaacccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaataaa

SEQ ID NO: 9512 - DNA, 3370 bp, Homo sapiens
cttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggaccaggctggtctcaaactcctgactgacctcaggtgatccacccgccttggcctcccaaagtgctgggattataggtgtgagccaccgtgccgggcttggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaataaa

SEQ ID NO: 9513 - DNA, 11842 bp, Homo sapiens
tggatactcacgtagggctggtagaacttggagagccgcggcttcccgtggttgttgaagattaggatcgccttgatcatggctgtgccgggccgaccgggtgggcactgggggccagggcgggggcgggcgcgcgagcctcgcctcgtaatctcgcctgcgatccttccccacccgccccctcccgcacgcgaccgcgcgcgctcccgagccgtcgggcggggcccaaggggcggggcctgggcggggcaggcactaaggaaagcggaaacatttctaggtccgagccagcggcctaactggagtgtgcgcattcgaccgagcacagacacgtggcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaagtaactgaatttatttccgggcagagaggcgggaggttcagattgcatccgagtaggggtggcggccagtaaagaagcaaaatttagaggagcgcctgtcctagacctgcattttgaccagtcatcagaagaaaagaagtgtactttttgatttttaaggcctttaagttgagtgttaaaataccatctctgtctatcggtgtagggcctgatacttggctgccacacttatttttatactgtatttttttgagttggccagactgcgagctctttgaaggagggagggagctgagtggggcggggggaggggggtctcggtaattccaggtacttaacacaggagctaattatttgagtaatgttttatggtggtaggggtggtcattggcaaagcctggattagaattcatgccttccaacttaactcgcttttgcttttttccccctcccagttggttgtgaattcactccttaaaccaaaaaccaaattcttatgcagaatgaagactgctaagggaaagctaaaggcatagatgttacctttttaagaaacacattttggaacctttgtgagttatttcattgcttgagtcagctatcctcaaccctttattgcttgagaatgtttccctttgtaaaagagattgctaaaattacgtgttctaaagcactctgtttagagttagagttgcctatgggaaaagcagcatataagcatcctcgattcagagaggctgatttcgtccttagacgttttccccgttctgtcttaagatgacagtggtctctggccgggcgcggtggctcactcctgtaatcccagcactttggtaggctgaggcgggtggatcacctgaggtcaagagttcgagaccagcctggccaacatggtaagactccatctctactaaaaatataaaagttagatgggtgtggtggcgcgcgcctgtaatcccagctactcgggaggctgaggcaggagaatcgcttgaacccgcgaggcggaggtggcagtgggcggaggtctcgccattgcactccagcctggacaacaagagcgaaactccgcctcaaaaaaaaaaaaaaaaaagacattggtctcattgctttttcttcaacttctgctactgtggaggataattctctcccaagactgccccccttcccactttaaatcagactcccatttccacctgatgcactataagtatttccatggatagccactggaatctttcttcaaaagaattccgcaggttttacagtgttttgttgcattttttcttccaatttactataggcaagagcggacgttcggagattcgttttaaggtctaacagtcttagtcaaaacttgttacttgactctgatgatagctgtgcaaaacaaaagctaaaaaaaatggcttacaatctaaatattgcccgagggcatattttcttggtctggacagtatttttttgcaaattgaactgtcatttaaggatgagatttttattttctggctcttgttagcatttgagtttgcctctccaatataaaacttagtttctaactattcctaccttgtgcttgtcattatttgttgaggataatatgatgaaagcagcttaactgttttgtatcctcagcctttgttaatctacagaagaaagattgttgaaacagaccaaggttttggcactggaggtatgttaggtttcctggggagtaagtgtttccctagttgattctaatgtgtatccgggttcagaactacaagcaaatcacctttaaaattaaaaagagagggcagctataattaaattattttccttctctggtttctcactgtcttacacttcatccttggtagcataactcatgatatttcctgcttcactttctggaaatgtttaattgaattaatcgatttattgatagccccaggggatttgagggagcagtgaaaggaggtatgaaagataggctaactaaaatcccacgttatctccaaattcattcctattcctaagataactggacctaggataattaagtagttctttagtaggaagataaagatcatgtgttctagatgcgttcattccaggagtaaacttgaataaaatgacctctgatcttttggccccaatatttaatacctaaagaatggagcaagaagggtgtaatagaatagagttaactttagggggcagcaatacactgttttgctttcaatgtgtcttgctttttgactgtagatttttttttttttttttttgagaggatgtctcagtctgtcacccaggctggagtgcagtggcttaatctcggttcactgcaacctccgcgtcccgggttcaagctattcccctgtctcagcctcccaagtagctgagattacgggcatgcaccaccacgcctggctaagtttttgtatttttagtagagatggggtttcaccatgttggccaggctggtcgtgaacaagaagttggaaggggactgggccctcttgaactcctgacctcaagtgatcctcctgcctcagcctcccaaagtgtggagattactggcgtgagccaccgcgcccagccagatgtatgtttgttttgttttagcaaataactttatgtctgagagacagattcatagggtttgggtttgcatatctgtgttttggatcgttgaaaccttaagatttctctttctgcaacttctttttggctttggttgttctattgttaataacttattgctttcctttattaaaaagtttattacagaaaatttggtagttacaaacagcataagtaaatccaagtaatcattgcctacaatgtcactactgagaaatatcattttgttgcatattcttccatatttatgtgaatgtgtttgtgatggtttttaatgaatttaagatattatacatgctgttggagagattaaatatccacatatatacccagcaagtggcagagccaggattcgaaccccaggcagttaaaagtgtatgcggtttactacattctatttaatcagtcacctccaaatatcctttttgggtatttaggtttaccagtgtttcatataaaaataaatgcttaaatggaggtgaaatctttttaagtgaattttcacacatctcatattttcttacactggattcctagaagtattattgaatcaaagtatacctttattaggatctgtattaccatactgcattccacaaagggtataccattttacattctcaaaagtagtatcatctacactggtaattactctaattttaactagtttggtgggtgaaaagggacatgacattattttactttgctttttgtgaacttaaatattgtttgtgtattgatcatttgtatttcctctctttggaactgcctgttaagataaaaggcattttaaaaattagtcctgttgggagaactttgtaggatcaagaaaaaaatgatggaaaagaatctaacatttttacatctctcacatatcttcagtatcataaatacgtaagatggatgtagattaaatatttctgatttctaagtcttttatattccattctctttagatgtttcagtgtaattgtcagtaaattttattcttcttttacagttgacattttgctaaaggctgtgggagacactcctattatgaaaacaaagaagtgggcagtagagcgaacacgaaccatccaaggactcattgacttcatcaaaaagtttcttaaacttgtggcctcagaacagttggtatgaaaccaatggtgatgttttcctacaaaaatttgcagtagttcctaggcaacagtgaattaactgttgtttatagaaatgcatatggagccacatatgtcgcttttgttatgcccttttatccctttatttttatttattcattttttttttttgagacagtctcgctctgttgcccaggctggagtgcagtgacacactgcaaccttctcctcctggttcaagcgattctcctgcctcagccaccctagtagccaggattattacaggagtgcaccaccaagcctggctaatttttgtgtttttagtagagacgggccgcctcagaagtgctagaattacatgagtgtgccactgtgccctgccttatctcttgttagtggagtttatgtactttatcaaaggattctctggggaattctgaaatgaaatgttttagatttgttttacaatgtgaaccagtttatgtatttattttttgcctcctgtattgttttcctcagaaagtcacatgaaagtatgcatgaatacccatgcataaaaatctatcatagagcattgcaatatctgtacattactacagaagttttggattttttcagtttgttttgatagcagttacttttttcctatttttcttgaggtaagcaatgtatctttgccatatattgtgaaagaactaggaaatacttcatgttaacagtacacgttaagcacttcacagtggcagttgtagtaaaggttaattctttaaatgccactgcattttaatttggcatttgactacagaaatttaaatgtctacatgtatttggcacattaagtgttttttatatatacataattatatgtatgagacacctttatctgcaaatagatcacaatcttggatagtattaactcagatagcatgagtggataaggtaattgaagaattgctaagtattttttaaataaaatcaggaatttttgggggcactgggggaaatatttgcttctgaacacaggcgtgtgcatgggtaaaacaagtgaactatcattaaagcaggaacatgttggaatttctttttgtccagggaggagcaaaaaactgactctgatctaagagtttggctgcaagtgctctcacaaaagtgaagctaaatggaaaagtcaggggaatgaggacatacacttgagagaaatgagcagaggctgcatctttgctaaagatgcaacatgaagagttggtaaaataagagtactgagtaatttaatgcattagtttagaaatacatggagatttaagaaaaatgaaatgatactgtgttctgtgttaagagtcttgaaattttgtattgcctgtattcattcagtaacctgaaaggacttgattgataccaatacatagtaggttgaaccatataaaattgccatcattcagccattttaccctatgaaaacaatttcataagggttaaattaaatcctctgtagtgaatatgattatcctttcccatttaagcaataggaaacataagaattattttgtcattttcctagattaaactaaaactgatacctcctgaattttatctagcaaaatggatgttaaaggaaaaaaagtaatgctaggaattctgggaagatggtggaatcagaaggtacacgtgaatctctctgaaattctcacaaaacttagtcaactagatagcaaaaccaaaaacccctgattagtatttgtaacaaaactaggtgataaggtatccccatgagccccaaaacacatgttggtggggacaaaccaccagcaaccacaggacctgcatggtatcagcatctgtgctgaaagaagcagtaagaaacagggttggcatctgacggcactgagaaaagtagaacctcaaaaacgctaatagatcctgaccgggaagtaaagtgagccaatttaagaatagaagctgactaaggagttttgccctcttctgtagcacgtgatgacaatacatttgcactaaggacttgaagggctcaaacaatctcaaaatggacccaggagggctctgggaccccatactgaggagaaatttcaggaagtgaaatgaaaattgaaaagggtagggacatgagaaaggaaggaaagagaaagaccagatcaaaatggtggggaacagagcctggaaagctcaaagcaggcctccatcgttttgaatagtatacaaaaaacaacaaggggagctctgtgaagttagaaaaactaccctaattcacctcattctaaaagttgaggaaaactaatttcacataaaaacaataacaggaataacaaggtcaaatcccgtacagtgttacaagaaaaacgagatgcggaaaagaacagcatccctagagacgatgaaatcaagccagaaatatacacctataagacaagtcgaaaattgtaaccttgtatttcaaaatgagctaaaaacaataagatggtataagacatgaaagaaaaacgatcagcattagtaaaactaagaaatgaagctcaggaaaagaattagaaataaaagaaaattatttcagaaatggagactaaagtaggaggaacataaacaacggataatatgttaagaaaaatagaagatgaaaaaaatttaaaaagtgagtcaacctttggacaagagtctgtgaagaaaaccagagcaagggaacagaaaaaatactgtaaaaatgtcatttaaggtaagagatttgaaactacatattgaaaaaacatctgaagtacctgagagtatcaacccagaataatgaacatcaggatgcattctgttaaaattactggacttgaaatcatttggaaatgtaggggacgggaaagagggcatgacttagaaagttaggctgtcgtcaaactttgacagcaaagatgcttaaggaaaaagtgtgaaataaggctttcatatcctggcataactgacttaatcggggcacagactattagcagaaaatgctattccagtgaaccatgaggaatccactagacagagagctttataacctagaataactagagactatcaatttaaagactgctgatttaaaagcagaaagaaaaataaagctgatttaaaggcaaagtaattaataaaactaactaattttgtctgcccaagttcttgcagtttggaaataatacttccatggaattttactttcacaaacctggagtaactacatgtactttaaagtaacaaattatacgccacttagcgattctgcagtggaattgatgatgttaacctgttacttatatagagctttatagtatgcaaacagatttatgtctttctgtcttttgaactaactgaattgcttttttaaaatttccagttaacacctgttacaaaatcacattgaatgcctttggttggttctctgctccatcgagtctgctgttttctgtgaacacaacaccatcttactctttgtctcctttgcctgtgaagtcctgattactgctttcttcacctggttaaatcctgcttatttcttatttcccacaaagccatcactgacccttttgctaggctagagtagtgtacatttctgtacgctacatacttcattagatgtacttttctcacccgtatttattcatgtgtgtctctgcctctcctacagattataagctcattgagggaagagatcacattaatcttcatagttccatgtacaattctcagcacatcatagacactgataaactaagctgttattgagagcccttcccctcatttataatgtacaagagtaaaatctggatttgctcataaattgtcaggcactgaacacaaattatatctgtattacaaaaaattcacattataatgcacattgttttctgttacagttctgaaatttttgtgccagaactctactcagccataaccacaaattgatatttcagcatgaactatttaaagataatttaacaataacgtctattgagtacatataccaggcactgaaagttagtgtattatctcattttgtctttcctaacagacccaagaggtataggtcctattattttccatatcttacaaataaagaggatgagagattatttgtaaagccaggattcaaacccaggtgtgtctcagagcctatacacttaatcaccacactatattggctaagagagatgcaagcaatattgatggttcatggttggtgatcaaaatagtatctgtcaaccaactattctgatacttttttttttaaatactaagtttaatccaggacattttagtcccaaatttggatattaaaggaaaactaaatatgttacctgcaaataaagttttgttttccaaaaagaaaattattaaagggcacttcaacactgtgactttaagtactagaaatattttagtaaaaacagactaaactgaaacattgagcagtgaatcctttaaagagcaaggttataaggttttaattgttactttttttcctgcttcatttgcctgtaagtgactttattaaaaaacctaagtatatatgtcatacatttacccaaggaaagtgtacaaactaccttgaatattagacatattgatttttggctgtgtgcctgtgtaattatcttaggagaaattctttgtgggtaagtggggacatttttacgataatgtaatttcttgaatagccagctcttcaaaagctatttgtaaaaaatatttaaaagtttcttagttatacaaagttaggaaccactgttctaggaactggaattgtgttatttttattcctctggaggaaaaatgagatcttcgtaatgatctctttaaattgactatttagaaaagttaggagttcagagaagctttcttcaattgtgaaaacaatacaaaatagctagctgattggaatgcagaaaaatgcagattaatcaggataccattaaacatctctgtttttccttcctttcttgtagtttatttatgtgaatcagtcctttgctccttccccagaccaagaagttggaactctctatgaggtaaaaaaaaaaaaaaaaaaaaaaaaaaaagaaagaaattactgcttttttttcttaatcgagtatgcacatctgtataatatgtatattgtgtagtattgttaattcacatttttatttcaagagatggcatgccattcttaattttctggggtagaaaagatgactttcttgttctgttatctaacatcttgatcatagaaagatattaataaattatacaatgattgaagaaccaaggaataaattacatttcaaagtcatcttcatgattctcataaagtaaggctttttctttatctacatttgatttcttctacattgttcttataatctgttatccaaatctgcctacaagaaattgagaaaacagcataagaatgactgtttaacatcttacagagtcattgtaatagttattagagtacacatactagcaccactactagaaaacagctaaaattacatatattgtggttggacatgtagagaaaggacaagattaaaatacataagctcattcatgcctaagatgcttaaaggacagattttattaaacacttaggattattaatatgtgtctgatagaaacaggcatcctttgaaagagatagcctgtaacataggtaacttaatatacgtgtgtggatatttatgaatacatgtggcatttatcttcttagtttatctaagaataataaaagattgagtttgatttattgccttttttttttgtagtgttttggcagtgatggtaaactggttttacattactgcaagtctcaggcgtggggatgaaccacaaagaaaatgcaacttgctactacatgaaatggattttcacggaagagacagctctgaaaagtttgatgctttgtggcaagagacttatacagatgtgatctatttagtatgttctactctatgtttatgcataagaaaacatgccatagcatgaatggactcagagaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaatatattatatatttaacaaataaaaatatgttgaattttcgtattgtttgccactgagggttcagatgatagacctcaaaaaatcgaaaatactggttg

SEQ ID NO: 9514 - DNA, 3883 bp, Homo sapiens
attctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaacgtgtgtattttgtaaatgagtgtgtgccatcttattctaatcttgagattactttcttacacgtttttaatggagggggcttttttaggtgaaaaataaagaaatggctaatctgcatgagcaaaca

SEQ ID NO: 9515 - DNA, 1068 bp, Homo sapiens
cagttcaagcaattctcttgcctcagcctcccaagtagctgagaatataggcctgcgccaccatgcccagctaatttttacatttttagtagagatggggtttcaccatgttggccaggctggtctcaaactcctgatgtcaagcgatctgcccgcctcagcctcccaaagtgctgggattacaggcatgagccactatgcccagccttgtcttcccattcttgctgacttctgattgtcctgaaatccccacccattagtcattcctcgaagttagtggatataagtaagtttgtctaatagagaccatacgttagtcaacacctcaatggcatgaagaagaaaagggaggaggttgggtgtggtggctcgtgtgtgtagtcccagctactcaggaggctgaggcgggaggattgctaaagtccaggagatcaaagctacaatgagctatgatgcttgatcgcaccactacaccagcctgggcaatggaatgagactctattattctagattaaaagaaatgtaagaagtacaaaaatcaaatgcagcataggtgattttagcaaaccaaatacacaaaagacttttgtatacaggaaaatttgattaagtattgggcattagatgataccaaggaatggcattttcgttcattgtgaaacatgattatgtaaaaaatccatttttttaataaagatggataacacaatagctgcaatttcctttaaagtaggaactaaatatttttaaaaagtaaataatgcagccacgcacggtggctcacaccttgtaatcccagcactttgggaggccgaggcaggcagatcacctgaggccaggagtttgagaccagcctggccaacatgatgaaaccccatctctactaaaaaaaaaaaaaaaaaaaaaaaaaaattagccgggcatggtggtggccacctgtaatcccagctgctcgggaggctgaggcaggaaaatcgcttgaactcgggaggtagaagttgcggtgagctaacaccactgcaccccagcctgggcaacaaagagtgaaactccgtctccaaaaaaaaa

SEQ ID NO: 9516 - DNA, 580 bp, Homo sapiens
ctgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaac

SEQ ID NO: 9517 - DNA, 9558 bp, Homo sapiens
gaaatgtttctcagttttagcttttgaaaacccccaggtatcgatgaccctggtaaatggtaggctggagctttcagtggcacctacatgatttaattgatgaactttttagatttaaagaatttccttaatcattgttgtttgttttatttctagttttggttgatggagaattgttaccacagatttttgtgaagatgttacagagggataagcctattgagatgcagctcacatcagcaaaatggtaaaagtcaggacaatgtgggaagaaagacagtgctttatcaatatcttagagtatttttggacaaccaaatttgcttgcttccaatccccattttattttgagattttgaaatttgaaagtcaggagtccatcccacattttcttaaatggatgtgagttttttatactcagcttattactagtaatatgcagaacaggaactctcgtataacatctgagactgtcttcagaaaattactttattacatcctcaaactactgtccttctacttcagttgaaataatactgaattagattagatttaaccaacatatactatgctaagtattagccagggaaatacaaagatatagaaatatggaatgagaattagttgaagttgataaccaagggatgatttcagagaacgtggcttcctcatcttttaaggaaaaaaaaaaaacacaaaatcttcaaaagttgtgatggtttagaagatacttatgcaaaggttttttttttttttttctagacggagtctcactctgtcacccaggctggagtgcagtggcaactatctcggctcactgcaacctccgcctcccaggttcaagcaattctcctgcctcagcctcctgagtaactggcattacaggcacatgccaccacgcctggctaatttttgtatttttagtagagacgggtttcaccatgttggtcaggctggtctcaaactcctgacctcgtgatccacctgcctcggcctcccaaagtgctgggattacaggcatgagctactgtgcccagctgcagagtttttattagcacaatttctggctcatgtaagcattcagtgcatgttctgtaattatcaatacatgaatgggtgtgttgagcacttgtgtagggttctgtgctaagtttaatcttagtatttaagctgtggttctaacattttggtgagaatttggcattttcaatgaattactcatgtatcgtgaattgtttggtttttatttgtttgtatcattttttgctttttgtctttaaaactgagcatttgcctctgtcagtaaggtaatgttctaaagtaaatggtttcagaaaaacaatatggtaacaagcctcaagataataacaactacaaatatttcagccgtctacaatataagtaaaatgattttacctgtttataactttcggtagaagccaacgtgagatgttttaatttttttcccccatcttgctaaaggaatgtaatcaaaaaggaaattcattaatttaaatttctgaagcgcttaatgttcagcgcctgcctggggaataaaaattaattatattcttattcaaaggcagcttataattgtttttcagtagaaccaaattattgactcgttcccaaagcccctgctgttaacctctgaatagttcatttctgatggatagctgtgttacaagttaaatgcctcttctgtgatacttctactgcatttggagttagaatattccaacttcatttaaactgagataatgtgttcatcttatgtttcattttgaacatttttccctttttattatggaaaattctgaagtataaagaatacaacatgtgcccagcacctagcctcaaaatgtgtccatcattaggttatttatttttaaaactatttggtaggtttttgtttcattttgtttttttaaatatctggcttaccatctgtatttgtcagttagttttctttgactattaaattgactgaacctccgaaaagcgaattgtcaaaatcttcactctcaagataagtgatattatttggttttcgattttttaataaaatcttaaaggcaaataatttttcatttaaagctttaaactccaagcaaaaacttattttctgctgtcttattccagtttaacttacatgtgtagagctggagcaattcggacagatgataactgtattgtattaaaggtaagctaattaattatctttaaaatgtgaaaattatccagttatgtgttaaatatcagtattgatactcatatttcattttacacatttatcattatgatatatgtgcatggcgtagaataatattgaaagaccatgctttcttttcagtggatgtcatatagtttttaaaaattgattttagatgtgtttcgaaagtcagcgtgaaataattatttcattgtcacagcctttcattttatggtaattaggaggatgtggaaattgtaaaagtgtacaattcaggtgaaacagaaaatatatttcgttcttgattgtcattaaatttgtactacagttttagaggcagacgatttgccacttttgcagaaaaagactttatatcattctcatagctgataatcaaaaggcataatgaaagagaataagtagataacacatgaaaacaagcattgtcattgtgatatgtcatatacaacttgaatttagaaaaacctggagaaaagaccagccctaaaagtcctaaaacctggattctggttttagcactcccacctctgactgtacatcctttattcttttgatgcctcggactccagattatgaaaattgaagcaataattcctgctcatctatgcacagggttattgtgaggataacaatatattaaatacattaaaatgtcttattagctataaaaaattaagtataagtaaattgatgatgtgtcattttataaatatgagatctcacattatcattgttcaaaaggtgatcccaaggataaaagagcacaaagaagactaatatttgctttagtctttggggaagagaattaatttaatgagatctgaacactccctaagtaaacaactcttcatagagtgccacggacttccatagcatttatcttgatttatttacttctctaaccttcctctttttctgcattggtaaaatgttagtagtatattcttcacatagtagtcatgagcattagattacataattcatgaatttatggtatcaataaatattagtaactagtaatgttagggaaaaaagaatagggccttccccttggaaacctagggttgaattataaagcttctactagcctaataggaaattagtagtgaacgatgaagtgctaagctctgtggtaaaagatataataggaacttattatatataaaagagcaaagcacagttgcctgcagtatttgaggaagactttctataatgataacatttcaatttatacttccacattgtcctttcaagtggatccgtcaggcttagaaatagtaaatgtcgttcgagaccagcctggccaacctggtgaatccccatctctactaaaaataaaaaattagccaggagtggtggtgggtgcctgtaattccagctactcagaaggctgaggcaggagaattgcttgaatccaggaggcagaggttgcagtgagccgagatcgtgccattgcactccagcctgggcgacagagcgagactccgtctcaaaaaaaaaagaaaaagaaatagtaaatgtctgtaatatttttattgagaacctaatgtagataagttaccaaaccattgccaagatttttgagggacctcagaagtaaaattggactcatggataccactgctaattccagcaagttactgggaaaacctagcaactgtgatacatttcagttgcattatagtagaactggtggaatctgagtaatggtaagatcactgcagttttaaagctgtattttgttttggcaactgtaggtatgactccccaaaccaaaaaataaacgatattactcactaaggaagagatagcatacttttcctaaggcaaaatcattcctgattaaactgctgggtcttttttaggtaaataaatagatagatagggcagaaccatcagacatgatttgttagggattcttaaatgtcttttacaaagttgtacaataaaacttgtcttatcggtcccaaaagcctaattagaatttgtattaatatactttgacgtacgaatagagtttaatgtgccagtacaaattattaatgtgtactgaattttgcttgtttttgcattttaaaaaaatcttttattctctagaagtcagtaaaggaaatatatgatcataaacattactcctgataaaagctattgagttgattcagtcactatatgcttaagcttttacctttaccaaaaagcaaataattaatctcactacctttcagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaagggtatgttattttccttttttagcagctcaagggagatttttctaaagtttttcttactgttcacagttttgaaccaattgataactacagcttaaagcccttttaaataaaggttcttttatctttggtaacatagataatattgctttgtgaatttttgaatccaagttgtttaatgtttattgtcagaaagtttttactgagcagataagcaataaagaaaattgcatcctaactccccaactaaacctcaaaagtagtggattctccaagctgggtattgacataaccgtataatcttattcttggtcatggaatcatctctgttgttacattctcattctttaggtcaggagtaatctttttgttacaggagactaagttgtcccatgttactttccaccacagtctattttgttacctttccctatcttctctttttcccagtttcatactgtgctttgggcctgctagtgacagctaaagcatcatttaatcttgaatttgggaccaaaaaggccaaattgtgctttttctgaaaacctaagttccttagaatagatcggtatttattttgacttgttgcatctcagcctgtttgccctatccatttctttaagcataggagatgaacattctgtaagagaaagtttattcaaggaggtcatggtagagagaacattgcctcttaattagtagccagtactgtttcatgaatgtaactgtatttttcatgccagtggttccaatggtaactattctccttttgacctctccctcatgcttttgagtttcaaaaaacctcatttggtaggcagttgttcatttggcttttaactttgaaaataaagcaaactattaagggtatatctttactctgtcttaagaagggcctaaaataaccttcactggtatttgtattagtaatgtactctactctttttgtattaaacttatgtgtctgctcttctttcagtagtggtgtttttccagtagaagtgatgggttacatacatttaaccagttgccttgtctgttttccttctggtcattttttcacactgacactgtatcttaccaatacaaagatacatgagcaacccttagctactgcctcatgaacgccctgagttgaccaccccaggaaggcaaataaaatgttttgatggccatgagagtaaggaaacaattttaagaacatgtagcctatgcatatgcaaatcatttaactagtacgtagattatcccttctgttagtttttccatttcatttccatcagagtaaaactgtaacaacaataatccttaaaaatgacatcgtaataccaaacttgagtaatagtttgttttgtcatctttatttttgatgatggattatccaaaggtttctgacccgaaaagtatagacactagacccgtaaagagaaatcttcacatgttaataaatttgtgattttcatgatatgttagttcaagtcagtattatatcttaatttatgactagaatgtagttaagactttaagagtagatacttttagaacttatcaaagtgagtattctgtattgggaagttcttcctataatccatcagtgtctgctttgaacagaagttttggaactattaagaattgccttcagagccaccccaaattatatatatatgtaaaatatatatattgtcttttgctttctgtggaattttttgttacctacgttatattacccaactgaatttctccatcttcacacacagtcagtgacaactaaaagtctcatcattgatcaagctataccactgtcagtgttttctagctaataataccagttagctctttaggaagtttcaaaagagggtctcagaatgttatgaacaacacctacatcattggatgagtgaacctttccaaagtaacttctttgggaaaagtggtattcatttggatgattacattaaggcttttagttacgaggttatttatattattggtagactttgtatagttacttggtcatagtcagtcattgaaagtatcctgaaaatatgcttctgttttatctttacagtagtttggtgatcaagtttatagaagagttgataattagttatgcatgtttaaagataccattaattgcttcatgctgataattttgataatgttcttgaaaaaacccatacccaacataaatctcagataactgtaatagataataatggttaccatagtatacggtttgttaagcattttcacaatgggttctctgtttctaaaagctttttattttatttatttttatttatttatttatttttgagatgtagtctcgctctgttgcccaggctagagtgcagtggcgcgatctcggctcactacaacctctgcctcctgggttcacaccattctcccgcctcagcctcccaagtagctgggactacaggcgcctgccaccacgcccagctcatttttttgtatttttagtagagacagggttttatcgtgttagccaggatggtctagatctcctgacctcatgatccatctgcctcggcctcccaaagtgctgggattacaggcgtgagccaccgcgcccggcctctaaaagctttttaaatgccaaaattaggccagcactactcttaatgtttcagaaaattaagggaaccctcctaaagacattgttgcgatttcattcaggttatcagctgtagtctggggctagagaagtccaggtgtgccttcttttgaaggagaacatttcaaagagctgctgcaagcaagcattagtgccagtaaagctaccatttaggaacactgaatttttcggagtcagagattcacaatggtttttcatatatcagtgtcaaatatagtgttcacttttaaatggaagcatattgtgtgcattttaggtcacattgatacgaacactgcaaagtctcagtgctatgtgaacagaatccaaaaataactgggaaatgtagttaatgactgggaaattcactaaaatctaaaagttgtaaactttttttttcttcaactcagttaatgttattgaaagttgaatttatggactgagttggaacatatcctttttttccccatagcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagcctagtctaacactgaactcatgttcttgatgagaatacttctagatgaggagtatagtggtaagtaagctctgacttggctccttccacaaaccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaccagccttacatttgttgaaataacttgaaaaggacccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaaagttataattatt

SEQ ID NO: 9518 - DNA, 160 bp, Homo sapiens
ggggcttatatagcattttaaggaagatatttaatttctgggaaattaagtgtttgaataatttacagttcatagtaactactgaagagataaattgtaaaatggaaactataaagtaattttgtgataaaatctacttgaagactggccataggcgtgg

SEQ ID NO: 9519 - DNA, 567 bp, Homo sapiens
cagctatctagtttagtcttggtaaagagctcataaggataggaatggagagtggaactaacttcaaactagccagaggcaggggaaataaatatatactgaaaggtacctcctctttcctgtgccatgcaaaggctaaaccagtcagcacttgcacatcaagaaacaattgtttgggtggctgtttattgttcctttacttcatctcctctagcttcattaattcccccagctcttcctccatttctcctatcttttctgcactagacttccttatttactataatgatttgaaaaacctacaggttgtggaaaggggactagtctggtaacattactcttctgccagggtttgctgtattaccaaagtgccattaatgtattctaggttcctcctgtgggcacatgctagtgctgcagagcattgcccaagtgaggggcagggcttcttcataccccagctacctatcctgtgagtgcttgtcaacctcaggttccacattaaaacatcatgtgtagactcagacttagaagtgaggattagattggattagaatggaaagaatt

SEQ ID NO: 9520 - DNA, 4683 bp, Homo sapiens
tgttcctctcgtctgattgttccaaaggctgctattttccaaacgcagacatatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtaagcaaagctcttttttaaaaaaaaatgtgtatgatggacaataactgatgtcatgttactgtgggtatgtagagttgcctataaaaatgtcattttatttcagcattaacaccaattggggactgtatgaagattggcccttgtttttaataaaacctattccccacaggggatttaatagaatgccataaaagaattgaggtgcattaaggggtgtttgttatattgaagacatagccttaattttctataattattatataagccatgcaaacctacaatgatgcatgttaaggacacagttctctgtcacagagcattcactatgttttgtgtactcttcattttgtttaatcaagacaattgagaattgtgatgggggtggtggcagccgacaaaagcatttgtttctatgaaaaaaagaaattaattgggctacctactggaggtgtagcttacatttgttcctttctcttttttttttttttttggcttattaggtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaaggtaaaatatgttggcgttctttcataacgaagctttacctagaaaatacctaggaacagaatatatacactattaagtgctcagatgttgatgagtactgctactataggtatctttattcctactactaaaaaatcagaaagcattagtcctgggagggactttgaaagtttagctttatctaggacgcaaagctgctgatagcagattcaggaataagatgtacatttcctaattcctatttgtaataggaaaacaatgaaaaacagtcaaatgtatggtgtgttatgtcttttctatagtcatatttcagtgatatttgtttacctatatctcaagagactagaatagaagctattagtagtagtttaataaaaggagaatctattttttattgtaatatgcataaaaccttgctgattagagggaaagaatgccatattttttatcttcaagtttagctgtttcttgtttttgtagcagttaagaatcgagattaatttttgagtggatttcttaactccaacttcatttctatttcagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggtaagcaaagcaaaagaaaattagacttttactgtattattttcaaataatcattttttgtcatccgttcattagagtgtctgttgctgactcataattagtaagggatacatttaaatttgtttatacagtggtaatagattatcgctgattcatttgccagatttttttactattgtccttgtgatctatggcatcagatacagtattgtggattgcctttaaggtgtgttatttggccatggaatatagagaacttaagcaccttctgggacttacacaggctctgaccagcttggcatataaccatcatataattacaaataggtactagaatcgttttaaataatgctacaacactaatctcagtccgctctttttttgcaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacggtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtaagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcatcgtgcatagttctttcattgtaagccgctatttaaattcccacaatgcaaaactgttagaccagtaattgtgctactgaaattgtcacaaaacgttattccttgatttggtttttaaattttgctttcgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaaatgatactggcatatctgactgtaagcagtaggttgaagatatcattttatgaatgtggagaattctacattgaaacagaaaatacctgggaatgaagattaaaaatgtagctgctgttatttgcttggttattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggttcgttttattaataaaattattacactaatgctatg

SEQ ID NO: 9521 - DNA, 2446 bp, Homo sapiens
aagcttgttaattttaataacaaatctttatgaatctgaagagaattgatgttcatgataatgatatagatgtttaatatactttctgaaataacactgtttactgttcaagttatattgactataatttacattattcttgtttgagaattgtatggcatagacactcattagtcagagtgtctagacatccagaccatgcctgataacacaagaatcatatatcattctctagaaaacaggctgtttggttatagagtatttatcttaaatatattaacagacactacataaacattgaaaagccatgcaagttatagctcacaggagccagatctactgcaactggggcctacatacaaaattttatggcagtggtttcagtatgacaatcttttgaattgatgccgtatggtaaaactataaagattttttaaaagctctgtctcagctagaatttttaagattataactgaacagtatagcccttttagttgtttgaaaattacataatgattcaaaagcttgtttcactgcctttcccagcactaagaaaattaacaatcatttcttttaatttccttgaatcagagccattctaaagtgactctggaccagcaattctgagctatgatttcatgatacatgtattaatatctaaatgagttgtgagttgacataagaaccatagttccataataattatcttcaaatcaatggatatcttaaatgtgtttttttcttccttagagattattattaaactgatgtatttgataataaagaattttaggactgagaaagttaagtttttcttaccaataataagatattgaaatatataaattataaaacagaaataaaatgaaataaaggaggttatccctaaagtcatttaccttagtcacttgcaattaaatatggttacttcggaagaagaagtgtggccctaaagctactgtaacatgaatcatgccctaatgtgcactatatatgaactactttggtcagaaggcagcggcgggtaaggatggcttcctctcacagtgcttcttaggctatccatttaccaaggaattctaatctctttctctcacttcaccaggaaaggagggagtttaagatatagaactgggcatgctagcctcttttttcccttttgtggatttgtcataactgcagagaaccgatgttgtggtctcttgccagctacattgtgaaccttgcagtgaaagttctttgcctctgcaaagggagatttgtgcttgtgcagaactgcccatgccttagtaagcaggtctgtctaattctaagttcaatatctggtggctattgttggcataaacttaaagtacatcctctaacctagcctttttcagcagtaaacttaaaatattgaatctccatctgtctgtgtctcaagtggttcagaggtcaggagaggagagggacattattttatgactccctcaaactttaacaaagactagtgcagattatatttcgaagtaagcatgagatatattaaaaaccacatgtgggaattctttcctaattttagaggttttttttaaataatggaaattctattgaaattgagtagtgttaattacaaggcaacaggtaaacatttgttcaggatatttaaaaggtctgctgagttggaattgtgacagaccacattgttgactctagattgaattggaagggaagaatgtgaaatgaattaggatatcctctgttcacctctattaactttcttaaatgagtataacttagaaataataaaatgcaagtattttaacgttatagttgggagagttttgacaaatgtaaaccacccacttcacccaccactaccatcctgatatagtgtgtgtcccatcacccaaaaagttctctaaagcccttttgcagttggttcccctccacctgaacagccatccctagtcaactacttttctgctttctgtggctatacgttagatttgacttcagaattctagagtttgaaataaataggccatataatatgcactctttttgtgtctgactttttttttgcttaacatgatgcttttgaaacccatccatgttgagattcatccatgttatcatgtgtatcaataataagttcctttttattgctgaatagtattctagtatatagatataccacaatttgtttagctgttcacctattgatggacatttaggttgtttcaagttttgatctattatgaataaagctgctatatatataaatcacaattctatgtgtggacatatgtgttcatttctcttatgtaaatacctagggatggaattgctgagtcttatgaccagtttatgcacaactttaaaggaaactgccaaacttttccaaattatctgtaccatttgggatttctgctagcaatgtattaaattaatttcagtttctcca

SEQ ID NO: 9522 - DNA, 2444 bp, Homo sapiens
cttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaactcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaatgtgtacattctgaacattttctgaagtttctcttaattctgatttgtgtttctgttttgactttgaagttgtaacatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacattgtactgctatattatcccagtcaaaaccatactttcttttctttattttacaagctttaaaaaccctggaaacacttacttcttgcttgtgtctttccatttgatgactgggaattacttttctagataactttttttgaaactactcagtgaaatgaaaaataattacattttaaatagctaattatatctttctaaaaataaaaaagtagggctgttattagagtgccatgaataaataacttaagcacaaatacatagaaattggaatgtgatttatagtacaatctcatgagtatgaaaaggctatattaaaaaaaattttattgaaagtccacagtcatattcacaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgcattttgaagattttcctattattttatgttgttagcttttgaaaaattagattgatctacttagtgtctttcttatatgaacttaatatatttaaagtaccttgcatggtgcctcacacatgaagtaatgccagctatttcagtaaatgctagctatttctatgaagaacttgagttagtttggagatatttaacctcaatttcctctgattttaaaaaaggagaactttttttgtaatcctttccttatctgaaagtaagaagtctctgattccagtattataggagagatagtgggatttttcttgacagggtctatagctcaagtcccaaagaggcaagactcaggatggaatgcatgtggccactaggccctgttataagaacctagtgtttcctctgtactggcatggtaggccaagttagtctctttcttacccagatataagacataaaatagtttagacataagacagaggagaaaaagaaacagtaagttatggagaaggaaggcagctcatttctgcaggcccctcaaaatgcttattttagctcatactcttctatgcgtgaagagaaaa

SEQ ID NO: 9523 - DNA, 638 bp, Homo sapiens
acacgtgccatggtggtttgctgcacccatcaacccatcatctacattaggtatttcgcctaatgctatccctcccctttccccccaccacacaacaggccccagtgtgtgatgttccccttcctgtgtccaagtgttctcattgctcaattcccacctatgagtgagaacatgtgatgtttggttttttggcattgtgatagtttgctgagaatgatggtttccagcttcatccatgtccctacaaaggacatgaactcatccttttttatggctgcatagtattccatggtgtatatgtgccacattttcttaatccagtctatcattgttggatatttgggttggttgcaagtcttttctattgtgaatagtgccacaataaacatatatgtgcatgtgtctttatagcagcatgatttatattcctttggttatatacccagtaatgggatggctgggtcaaatggtatttctagttctagatccccgaggaattgccacactgtcttccacaatggttgaactagttaacagtcccaccaacagtgtaaaagtgttcctatttctccacatcctctccagcacctgttgtttcctgactttttaatgattgccattctaactggtgttagatg

SEQ ID NO: 9524 - DNA, 45774 bp, Homo sapiens
tttgtttatttatttatttattttattattattattattattatactttaagttttatggtacatgtgcacaatgtgcaggttagttacatatgtatacatgtgccatgctggtgtgctgcacccattaactcgtcatttagcattaggtatatctcctaatgctatccctcccccttccccccaccccacaacagtccccagagtgtgatgttccctttcctgtgtccatgtgttctcattgttcaattcccatctacgagtgagaacattcggtgtttggttttttgtccttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtattcctatttctccacatcctctccagcaccttttgtttcctgactttttttttttttttttttttttttgagacgcagtcttgctctttggcccaggtgggagtgcagtggcgcaatctcggctcactgcaagctccgcctcccgggttcacgccattctcctgcctcagcctcccgagtagctgggactacaggcgcccgccatcacgcccggctaatttttctgtatttttttagtagagacggggtttcaccgtgttagccaggatggtctcgatctcctgacctcatgatccacccgcctcggcctcccaaagtgctgggattacaagcgtgagccaccgcgcccggcctgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataccctttgcccactttttgatggggttgtttgtttttttcttgtaaatttgtttgagttcattgtagattctggatattagccctttgtcagatgagtacgttgcggaaattttctcccattttataggttgcctgttcactctgatggtagtttcttttgctgtgcagaagctctttggtttaattagatcccatttgtcaatttttggcttttgttgccattgcttttggtgttttagacatgaagtccttgcccatgcctgtgtcctgaatggtaatgcctaggttttcttctagggtttttatggttttaggtctaacgtttaagtctttaatccaccttgaattaatttttgtatacagtgtaaggaagggatccagtttcagctttctacatatggctagccagttttcctagcaccatttattaaatagggaatcctttccctattgcttgtttttctcaggtttgtcaaagatcaaatagttgtagatatgcggcgttatttctgagggtcaaactaccatcagagaatactacaaacacctctacacaaataaactagaaaatctagaagaaatggataaattcctcgacacatacactctcccaaggctaaaccaggaagaagttgaatctgaatagaccaataacagtatctgaaattgtagcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggcagagacacaacaaaaaaagagaattttagaccagtatccttggtgaacattgatgcaaaaatcctcaataaaatactggcaaaccgaatccagcagcacatcaaaaagcttatccaccatgaccaagtgggcttcatccctgggatgcaaggctggttcaagatacgcaaatcaataaatgtaatccaacatatacacagaaccaaagacaaaaaccacatgattatctcaatagatgccgaaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaacgggcacaagacagggatgccctctctcaccactcctattcaacatagtgttggaagttctggccagggcaattaggcaggagaagtaaataaagggtattcaattaggaaaagaggaagtcaaattgtccctgtttgcagccgacatgattgtatatctagaaaaccccattgtctcagcccaaaatctccttaagctaataagcaacttcagcaaagtctcaggatacaaaatcaatgtacaaaaatcacaggcattcttatacaccaataacagacaaacagagagccaaatcatgagtgaactcccattcacaattgcttcaaagagaataaaatacttaggaatccaacttacgagggacgtgaaggacctcttcaagtagaactacaaaccactgctcaatgaaataaaagaggatacaaacaaatggaaaaatattccatgctcgtgggtaggaagaatcaatattgtgaaaatggccatactgcccaaggtaatttatagattcaatgccatccccatcaagctaccaatgcctttcttcacagaattggaaaaaactactttaaagttcatatggaaccaaaaaagagcctgcatcgccaagtcaatcctaagccaaaagaacaaagctggaggcatcatgctacgtgacttcaaagtatactacaaggctacagtaaccaaaacagcatgctactgctatcaactctaattttttcatattgaaatagttatgacagattgtgaggaaagatagtttatattccccatgaatcaaaagctaaattgttacatccactttataccttttaaacttgtttttttaaaatacagacaccatcttgaggtgctgcatgataattttgatcagttggatataatttacagatttgataaattattgatttggtagcgattatattggataccatctctgatgttagactacatttaaatcctgcctctgctacatacttgtcttgtgatcttgagcaagttacataacctcttcgtgccttaattttctcatctataaatgggaataatgatagtatttacctcagaaggttgttaggattaaatgagttaatgctgtgctggaacagtgcttggcacttgaaagccagacaactgttattcaagggcttaatgaatgtttcttcttcccctctgtattttagcttatcattggtttgttctcattttcagtatttcttatgtacttccttataaaccaaagttcattgttcatataagataaacagtatacattgaagaatcaaaacagttcaaaattgtataatgattcacaccatgatggaaaatcatagtgatgaaccagataagtcagtcacgtgactcaggtcatctccactcactgctgcacatgctctgtcagtagtcactaggtagctttcaaactgctctattttaaagaataaaagtacttaaataattacttaatatattgattttaatatcagaattaaaacagacaatatttacttgtgcctttaatggaatgagccctctcaatttctctgttggacatactgctgtaaatgttttgcatctcatatccctgtgtacacagatgagattaggtgagctgtttgtagcacatttgcaggtgattgattggttaagatgtgagaatgtctctggtacagaagcctcacactagtgacctgggcttgagggatagaattcagcctctgtctgagaattatgaagaaatagtttgtcacagaccttactacccattatcgtatatgttgatgtttgccctttagtgctgccagccacatgctaagcctttaagcatgaatttctaacccataccaaggggtcagtcccctgtagtctaatcttgatccatgttgaatgtattgttttaaaaaatccataatttgaaggaaaacaccacagcaataacaacagcaataataatgcctttaacaatgaaaatgaaaacaagttactagctatcagacactattctaagggccttacatataactcatttattcctcataacaacaatgtgaagtagctactgttatttgcatcttacagctcagaaaacaagcatggtgagataaggaaactttactaaggtcacataactagtaagtggtggagccagcgttgaaactcaggaagtctgtacacaactgggagggaaggctaatatttgaaatgatagactcaacattcaatatttcagtatcgatgagctctaagttgatagagctatgtgtaaaaaccctgcatttaatattaagaaatcattggcagaagagtaagagagggctttggtcaagtaagctgagtgcataagaaaactctggcatttgaggtgtccttagctccagatgctttggtagggcagagtgtatccatggaggtaccatgagctaccatggaggtagctcagagaggaaagggaacagtaacagaggcctgcttggtttttaaacagttttgcaaagagtattatttacgtatttatactaagtctacaccagttttgagtatttgcctactacagtgtaagcaaatgcttacaggaaattagcacacctctgaaagatctctgcaccaaaggaatagaaaaggttgaagaaattatcttaaattcatatagagattttaatgactttaaatggaattataatcaactgtattttatcttctgttatatattcaagttgtatggttgtatatcacttgtccttgtccattgtatttgggtttcatgcttcatggtgtcacttttttaaatagaaaaaaatgtgaatagttaaaaataaattttatttgatatttagataatggtaaaaattgaaatgatgataaatgctgtttattgcctacttgtgaaggtgtcaatgttacgttggtagagtatatatggaatcatttatatgatttacagtaaatgaaacagaaggtgaggtaccactttcagatgtagtacagttgtctgactcagattttagaaatctattgatatttttaaagcaaaactttttttaatgctttacatttgaatgatgttctttgtacttggatattgatcctatttctgattcagttttgaaaggaattaacatcaagtggacttcatgtcacttaacagtgcttttttgtatacatttttaaagaaaattagtcattttactttgatttttgagttagcaattcacaagcaggtaattaaacacttttagaagaaaaatattggtctaataataatcttaactcatctttttgacatagtaaagaaaaaggaactctgcagaagcaaaattttttagtatgtggcaaacaactaagcaactagatttttcttggctttcttagtattcttccatagcttgtaattcattaaacattcctattcagctttctatactaatttcatatatatatatatgtattttgcttcatgaaagcattgctgcttttcttcttcatcagtaattagtaaacttagcttcctaaccccttataacttatgccttattaacgatagtgaacataccagtaagcattgaaattagtgttactctgatatgtcaaactcattctagaagttatgcttttccttaccattactgtattagtggacgtcctgcagcctatcattctattgttcattaaatacagctaatgaaccttatttagagtaattgaaagggaataatagaagattttaagggaatgacattttcttccaggagtgaacttataaaatattgttatttgaaggttttctagggacttctttttagtaagtaaattagaattagccctttctttataaattaatgctgctgaaatgcttaaaatatacttaacttttaaaaacattatctttgattttatttaagtgtttaattggcattatctgtggaagaaatgctttattaactgagacaccactgtgtttctgatatacttataaaaaaactcatgaggttttattttatttttcaggttttgtaaatagatatacagggaaataattaaatataaagaagtagactatatttaacattaactggaatagttaaccagttctatctatacattagaatgttcatcttttcagactaagtttactgaaaagattcttgcattaggtaaattttagtagattggactaagttgagggagttaatcccttctgagcttttagaattctaaagccattgcatagaaactctctgggaaagacaaatggttaagatatgtagccacaggctcctgtttggatttgtattgacatcaaaaagaagatgataatgatggatcttacatgtttatttgaaggctctcagaaagaggatacattctagatttatcctttatttcagaaggtagcattagcaagtgggaagaggagaatggtgaaggaaggcataagtgggagaaagtggagaaggtgacaggtggaaggcagaggcaaactgtcttggaagcagcttttagctcaaattaagatatcttaaggggagaattacccaacaaaagaacaaactacttaatgcagtcatggggttttacttctctacagttacttcttttttaaatataggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggtgagtatatatttattcaaaggatgatgtaaaaaaaaaaagttatggcagttcttatggaattgtaatcattatcatattcgcacatcgttgtacatcacgtaggaagttgctgttctcagcacactcagaccttagagtgtgtgtttttttttttaaccatcattgttcattcagtaaataaatagttactgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctcaaatgtctatctgatataaaatagaattcatgttttaacatgcattcgttttcaaactagtctgcattatgactttccggcacagactagagctcaattttgtctgttctgtaacaaaacagataacttaatacacatcatttcactttagttttacattgctttaatagaagaactctgtaaattctaacatttcatttatttagtattctatataattatacaacattactttttctttacgagaaaaagatcttcataaagtagacctcttcattcttaaacattttttcctttagtttatcattgtcagaaaagaatccacagtgctttttttaggggggggcgtgcggaggtgggtgacggagttttgatctcattgtccaggctggagtgcaatggtgcaatctcagcttaccgcaacctcggtcttctgggttcaagcgattctcctgcctcagcctcctgagtagctggaattacaggcatgtgccaccatgcctggctaatttttttgtatttttggtagagatggagtttctccatgttggccaggctggtctcgaactcctgacttcatgatccgcctgcctcggcctcccaaagtgctgggattacaggcgtgagccactgcgcctggcctgctttttgaagtactgattttaaattcctagtgcagtgtttctgactctgttgccttgactcccatttactgtctcctctttcatttaccctaaaaattggaagacagtctcactgatgctttctaactaatggtcttctgcccttgcaaagataataatagtatgtaccctaattaagatcagtcatcatcagagactcgcatgaatcaggccccactgtgtaggttaaaaacctactgacctgtgaactctgcatactgttgggcacacagtgaatgaaaaaaaaatttttttttggttggttggttactaatcctatataaaaatctaaaatttcagattctcttgaaaaatctaaagatttagtaacattgggcccatatcagagttatttaatacttccctgaaatgcagcaagttccacagttgtttctgtctcttagctttaatttctagatccagcctgttttaatctgtactaatcaggcttattttctttatctgaccatgtagtaatttgtttactactttgcatacaagagatataccattagtcatgtaatctgaggtatcctatatatataataaatatatataattgtgtatacatacaattcaacctcagcaaaacaacccaattaaaaaacaggtgaagaactttaatagcatttctcccaagaagatacatagatggccagcaggcacatgaaaaatatgttcaccgtcactaaccattagggaaatgaaaatcaaaaccacaatgagacaccccttcatacccttcaggatggctagtatcaaaacaaacaaacaaacaaaaaccaaaccagacccagattataacaagtgttggcaaggacatggataatttggaacccttgttgttgcctagtggaagtgtaaaatgctgcagctactgtggaaaacagtatggcagtttcttagaaaattaaaattaccatatcatctagtaggtccacttccagatatatatgcaaaataactgaaagcaaagactggaaagagatatttgtacatctatgttcatagcaacattattcacagtagcaaaatggtagaaacaactcataagtccaaaatgctatgaaatgtgattcagctttttaggaaggaaattctgataaatgctgcatggataaaccttgagaatattatgctcagtaaaataagccagtcacaaaacaaataactgtatgattctacttatgtgagttacctagagtagtcaaattgacagagacaaagagaatggttaccaggggttgggaggaaggaggaatggagagttactgtttaatagatacagagtttcaatttggaaagatgaacatttctggagatagatggtggtgatggttgcacaatagtgtgattgtactaaatgccactcagttgtacacctaaaaatgcttaaaatgataaattttaggtatcatttgccacaatacaaaatatatgaagaaatgatagaacaaaatatacgaaggaaacaattggtagttgtgatgagcacccatgtgaaagtaattagttgaaatagcagctctttcccctaattaatatttattcttattaaaatcatatttagaaatagtaactaaatttttacgaaagtgtttaaagaataaaataaaccaaattggtacagattatttgactgtgaccatctgtgggagtcattttagctttattataagatttttttttaattatttgcgaaactgttgacatttagatctatttgaatcaaatgtaagtgttaattggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttattcagtcttaagatttaaaaggaggtacactgttcttcttttgtacttttaattgcttttatcattgtaaattgtattctatgcaagagttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaattttattcacttgtgctgttataaagcaatttccatatacagtttggtctctttttagattttcttttctatttcactgatccatctgtccatgagttagtaccatacttttttagtaccacacttttaattagaaatgttttattgtatgctttaaaatctgataacaatagctttgctctttttttaaatcagttttcttagttcattcttattttattattcttccaaatgaattttaagcagttcgtctagctccatgggtaggagtgaggggtatttttatgggattgtatcacattttaaattaactttgtgagaactgacatctttatcatgatgggtctttctgttctgcaacactggtttaaatgtttgtgtctttccattagtttaaatgtttgtgtctttcaaaacagatggcccctgttctgttgaaacttagtctagtagggtagacaaagattaatcaaataggcttatgaactaatgtaagatttcagtagtgttatgtgctacatttttattggcagtaatagtaaatgtttcaaattgagtttatgttttaaagcaatgtactcattccatatttatctaatattgataggaaataaaaaataatattggccagaatttttgtaagtcgagagagagcaatggttgttaaattataagtggcagtgttgggccaggcaatgttttcttttttccactgggttattttactcttcatgaaagctttggcttactgttgggtgtttattttattgaaagcagtatatagatttaattcttagatatcctcatttatgtgtattacactcttactaatttgttaactgaatgtatgtggttctatcacacacatactgtgaagttcgtgccacactgcatgagttggaaatcagctgtcctgagagctgactgaaaggcaacatcccagaccatgggatttttagttaaaggatttaaaagttacacttagctgtaaaaaattaaaattaagaaccttggttgccagttaatcccagttttttccccacaccaatcctgatttgtgtctactgttggtatcttaatcttgttagtctctaccagtctgtgccttagtagcactctctgtaaaaatgggagaaagcaactatttttataacaaagtagatttgccttgctcataattctgaggattaggaataagagtctgtatttaattcattaatctttgaggatttggtgaaatgtaaaataatgattgctgcaccttagggggatcagttctgcaaatttgtgtaagataaactggagcagaaaaagatgagataaggagataaattaataggctcctaaagtaatccatgtaagaggtaatgaatacttgaatgtggttagaagaactaaaagggagatccctgatacagacaacattgtaaggataaagtccagaagcctttgcagattaaatgtggagtgtaggccagagtagcaacaagtaagggaatgaatttggatctggtctaggtgatgatagtttggtctccataaatagaaataatggatttgggaagcatttgttttggtggagttagtaatgtttgaagcttattgtcaggacttagaagccatgtaggtattgggatcaatgagatgaagatgtatctcaggagatagttggggattagagaggtagatttggtagataataaagcaatagttataattgagatcatcaatagggaaactagaggttaaaatccttgagttggaggatacctgggaaatgtgggaaaagtcaaggatggtaggatctaagaaaagcctcttaaatttggtaatatggtgttcagtagtgtgacagcagtaaaataaagaaataaaggtttcttccttccttttctttccatgtgtgcttaatacatatatgatgcgcaaatatctttttttaaacctgagttgaaagttataatattaatgaaacatttcttaagaacaaaatggtattatctcctgaataccataaggaagcagtattaaagagttaggcttttagtattattgccatcttttctaccctgttacccttttctcttccctgcctttattccttaactctccacgagaaaggcatcagcctttggtcttcaaaataagaactagtacaaaagatttcatgagaaaaatggatcctgaaagcatatattattgaggatttttgcttttctatactgctaaaaatgcctgcattttaagtttatcattaaggtgagctttggaaaaaattttagcctaatgtcgtcttctgctatggttgaaaaattgcaggctttggcatagctgtccccaaaatatcttagcacacttttttattttttaacgttttgaatttttttttctttaagagagagacaggctctcactctgtcacccaggttggggtgctgtggtgtattcatagctcactgcagctttgaactcctaggctgaagtggtcctatcacctcaacctcccaaatagttgggactacaggtgtgccaccatgcctggctaaatttttaaaacagttttgtagagacggtttctcactaggttgcccaggctggtctcaagctcttggcctcaggtgaccctcccacctcagcctctcgaagtgctgggaatgcagacgtgagccactgtgcccagccaacacacgttcttgacacggtgaggacatgctccataccatgtccactaaaagtctgggtagaaaaatcagttccaaatgctgaaggaaatgcctccagcccactgtatttgtgaagaaaatcttgggtatcagggctgctattttaattttgccttaaaacaagcattgctcagaatacatgttgtaccaaagaatatagacttgactttgcttgtacatgtgactgttttaagaaagcagtgtcgaggccacaattagaagcagaacacatttagtttctttgcctgcagccccaatgtctttggtacatctgtgtcctaaatcatagttgtagtaatgtttgtattcatcacacagcatcaaaaattaggtaagtatgacaggcaagtgcctagtgtgttttagtggtattttcaaaatgaattcatgtcacacccaaatgaattgctctctcagggaacccagtagagaaggttgtacctgagttaacttccagagcatcctctgcctatctgcctatttctgccagtggccagaatgaatttgtgtggtatatttttctcctaatttttatagcttttaatgtctacctaatgctccaagtttagtctgattatttaatgtgcagaaatcattaaaaccattttctgcctcacaaaaaactaaatcattggctgttactaaacaataattaagatttatacttcataggtatgtaagtataaaatcagcaataaaaagaccaggtgcagtgactcacacctgtaatcccagtgctttgggagaccaaggctggcgaatcacttgaggccaggagtttgagaccagtctggccaacatggtaaaaccccatctctactaaaaatataaaaattagccaggcgtggtgatgcacacctgtaatctcagctactaaagaggctgaggcatgagaatctcttgaaccctggaggcggtggttgcagtgagctgagatcgcgccactgcactccagcctgggtgacagagtgagactctttaaaaaataaaaaaaaaataaaatcagcaatacaagtttttgtgagcaagaagaagcaattttgttcttgcttctttatgattaacctacccaagaaccttaattactacagagataaaactaaactgctttttaaaaaataaagtagcagtaatagttatgctaaatatgtaatattagcataactaatattagctattagcataactaatattagctattagcataactaatattagctagctattagcatattattagcataactaaatattacatattactaaatatgctaataagtaatagttatgctaaaaatgtgtcaatttagtgtcagcaaccttttttttaaatagatgtattcgggcattaacgatacagatttttgcaccccagttagactgttcctgcttgtgttgatattctattattgcataacaagttacagtaaacttaccagcttaaaataatacctgtttgttttctaacagttcaataggttagaagtcctggcatagcatggccaggttctgaactcatggtctcacaaggctgaaatcaaagtgttggccaaggctggggactcatgtgaagcttggggtcctcttccaagctcatgtggttgttgacagaatgcagttccttgggactgtaggactgtggcccttgttttctttctagctctcagccaagaaccactgacagctcccagaggccacgtgcagggccttgccatgcgtggtctccataggcggttcacaacatgcatgtttgcttctcccgggccagcagttttatctctttacttcaagtctcttcttccaggaaggcctaatttcttttaagagattacctgatatatctgccctctccagggtagtttgccttttggttaactcaaatgcaactgatttggagcctcatatatctataaaatgccaccaattttgtcacataataggacctaataatgggagtgacatccatcatattcacaggccagatacagtcaagagggatgatatggggcatgtacaccaggggcaggaatattggggccatctcagaattcttcctaccatgttgccataagtaaaggggtcttctcaaatatgctcaacaggtgctagcttttatctttcatcaaatttttggaaaaataataccaaaatattaactgagaaataatttttccttagattttgtgtcatcctgaagttctttttagattatataaaacaattttttttcttaaattggaaaaaatactttccaaaatacttattggatattaaaatgttccaaaaattattttaagaaaatatattgcctaataccactgtaacttagcatagtgagttgagggcttagcatatttagtaatctaattatatcctcttacaagacaaaaatacctttgttttacagagtaatacaaaggcaagtctgtaactagttatttttcattctaaaagatatcataggttagatttgttatattagattgtactgatggcatattagcaaaattaaaaatggtttgatttcctggtcataaataagctgatttgcactataataaacaatgaataaacaataagtgaacaatgatgtaggaagtatcctggtgaaagccatatttacaataaacttgacactttttgaatgccatgtgaatattatttcatgagtataaaggatgagagtggtttaattaattgttcatctaccaaataacgtccactgcacagaaaaaaagactaatttcctttttaaaaatcactacttatgcccaattttaataacattttaattgtttggcttttgaaaatatgcaaatattagaacgtgacaaataatggtcagcagaccaggtaagagacaggatttaattttctagctcaaattactggtttttaattataaccttgacatctgtatatttctgtatcttttctccacatctcacctgcgttttctgaaagttctgttatattccttattgctaattatggttatctactttgctcttatttccagggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtggtagtgttctctaagtggatttttatttctttttcttgtttttctttttttttttgagacagagtcttgcactgtcacccaggctggagtgcaatggcacaatcttggctcactgcagcctctgcctcccaagttcaagtgattctcctgccttagcttcctgagtagctgggattataggcacgcaccaccacacccacctaatttttgtatttttagtagagacggggtttcaccatgttggctaggctggtctcaaactcctgacttcaggtgatccacccgccttggcctcccaaagtgctgggattacaggtgtgaatcaccgcacctggcctagatttttatttttcagattcaagtgtgagagagaaaataagaacaattactatgtgttttaagagtagatttaaaacagattagttttattaatccgtttcaatagtagctaagtgataaggataaaacactccaaatgctttgttttacagatttcctatcagaaaccaaaatttgtttgtgtgttaacttccaaataaacattagaactataattcaatttaaagttaccacaagttccacaacttcagtaacatatatattctctacaatctcatgtttcatgtcttaagtgtgatactaataattagtagctgacactagctcccttttgtggatatgttctactttttaactagggaattgataatctcactatgaagaactatgtagctagtcattctttccttctcagatgcatgcagtataacagcccctttttgttttcaaattactccattttgcctctctgtgcctttcctattcaggttattttcttcctatcagaagaaatgtaggatagcccagtttatttaaaatcgaatgggcacttaaaaaaataaatagataaatgtgtactcctagtggagaactatataccatatgatattttaaaagagttgaaaacagtacaactttcatgggaaacagatttttaaatatccattaatgattaatatactgcatacttgaataacctgctctttaaggacatgcagttggataagatactatgtatattgagtgtatagtccactctttgactatataatgtatatggactatgaaatatgtataattcaatcatatgtcttttaaaagtaggttattcaaggctgggtgtggtggcttacacctgtaatcctagcactttgggaggctgaggtgggaggattgcctgcacctaggcattcaaagaccagcctgggcaacatagtgagacctcatctctacaaaaaaattttaaaatcagctggatgtggtagtgtgtgcctgtagtccaactactcaggcggtggagattggggaatcacttgagactgggaggttgaggctgtagtgagctatgtgcactccagcctgggtaatagaggaagaccctatctcaaaaaaaaaaaaaaaaagttattcaaattaaggaggtaaaccttactttcaaattcttatggtatgtagagagcatttattctacttgaccaagtactttgctaacataaaatgtttaatttcttaatgatatttgtaaaaatgaaatcagccgcactttcatttgctttgtattatcttgaagtgattgtaatgaaatcccaaaatagagtgaaggacaagaaaggaattagatataatttaaaatctgtcatgcttttttgagagatccaaggaacagaatggaaaaactacagtgaagttataggaatattttattatctcattcatactttctattatgaatctgtaagaaataagatactcatgttatttttaaaaattacaaatccaaatagaaataattgaattgcctgtatagaaggtccctaatcttctaatgtcccttgtgatttctttgatccatgagttgtttataagtgtgaatttaatttcaaaatattggaagacccttcagttacctttcatgatttctagtttaactccactgtgtttagagaatacactttgagacacacttcattttaaaacaatcttctcaaatttattgagatttattttatatttataacatggcctgtcttggtggatgttccatgtgtacttgaaaagatggttcgacttataattttttgacttcacgatggtgtaaaagtgatacacattcagtagaaagcagtgcagtatttccttgcaatgctgggcagtagcggctagccacagctccaagttagccatgtgatcatcagggcaaacaaccactgctctgcagtgtactgtgtagccaggtgattttgcccaactataggctaatgtaaatgttttgagcacatttatggtaggctatgctaaggcttacctgtgatgttcagtatgttaggtgtattaaatgcactttgacttatgatattttaaacttacgatgggttcatcagagtgtcacttcatcataagtcaaagggcaactatatattaatagttggtttgttgatttattggctgttttatttcaggtggttttttttcttttttttttttttcccgaaacaatcttgctctgtcgcccaggctggagtgcagtggcgcgatcttggctcagtgcaacctctgtctccccggttcaagtgattctgctgcctcagcctcctgagtagctgggattacaggcacgcgccaccacactcagctaatttttgtattcttagtagagatggggtttcaccatgttggccaagctggtcttgaactcttgacctcatgatccacctgcctcagcctcccaaagtaatcctgagattacaggtgtgagccaccgtgcccagcccatttcagttttattaagtgatatttgtaacaaaagctgcttacagatggtgtatgtctatgtctgtcttctctctcctctctctctctgtgtatgtatgtacacacacatatattgctccttgtgtgtgtgtggtatgtgtgtgtgtacgtatatatacacacacaaacacacctgtgaaggaattgttcattatttggtaggtttctttcttatcatcttaaatatagtaacataagatatcccattcacaattgaaacatgaattttattacttttttctgtagttatatgctataaaaccaaagcgtctcagattttttatattcttcccttatactaagaattttaatagtgcttttcttgtgttaatctttaattaataagttaggtcattgagaatgaatttcttttcatttataaagttgcttgttttttgttttatttttctattccacttgtggtttaacggacaggttgctgtctttttgcagggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaaggttagtaaaattgaatttacttaatacaaaacacatgctaacttaactttcatgaaatcctttataaaattataaaattaaaagctacattgtgtagcttttaatttcaatttcataatgtacttgcactctactctgggtatatttgtgctagaggaaaaaaattagcaatggtttccttgaaaaagtgaattggttccacagtattaaataaatcacagatgcctttatgcagaaaaaagcattctgttctaccttgcttttatttcctctttgtcatatttgaataatgtacagttagttaacatttatttagcaggcaattactgagttcaattctctgttacatactgagctttaaaaatacaggttgagcaacccaaaaccaaaacttcaaagtgcttcaagatgtgaaactttttgagtgccaacatgaagctcaaaggaagtcctcattggagcttttcagattttggatttttggactagagatgccaaaacagtaaatgtaatattacaaaatctgaataaattttgaaatctgaaacacttctggttccaagtattttggataagggatactgaaatctgaagtactataatttggttggttagtttttttaaaagcaaaagtgggcttaatgttttggtgtgctttagcatttacataggtcaatttttttgtaagaacacatgaatgagttgtgtagaccaaatggttattttttgttttgaatattttttggtatggtatttaaacaaagcagtcaatatttcattaagtttaaaatccaaaacttttaaggatgttttagattataaatatcttatatattcttctttatacaaattttgattttatatttcttgttcagaatgcatttacagattattaaatttgtaatatttcttccaaaaatcaattataaataaggttgctgagagacatacagattttttagcatgaactgatagttttatttctttatttttgacctatatggcctttatattattttcttgtcttattgcactgactaggacctctgtctggtataatgaatatagatggtaaaagcagatatttttgccttgttcttgattttgggggaaaagcattcagtcttttatgttagctataggttttttgtagaatattattttcaggttgaaagaatttccattcctaacttgcagagagttttaaacatgaatagatgttgaattttctcaaatactttttgtgcatcttttcagataacttttcctttttctgtctgttaataaggtgaattacattggttgattttcaaatgttgaatcaactttgtattcctcatataaaatccacttaatgattaaccttctcatatattgtttgattctgtatcctaaaattttgtttagaatctttacacctatgcccatgagaaatgctaacctgtagttttcttttctggagacattttttcagatttgttatcttatctagtggaatgggttggaaaacatgtcctcctcctttattttctggaagagtttggatacaattggtattatttcttttttaattgtttagtagaattcactagtgaatttctttatgggaaggtttttaactatgaattttattttaaaaatgggtgcagctttttttttcttgaatgaattttggtagtttgtgtctttcaagaaatttgtgtcatctaagtcaccagatttattggcataaagttattcaccacattaccttattatactgtcattttatctgaagtaatgtttctgtttttgacattagtaatttgtgtgttttactctctagatcactctgactaaagggttatcagttctgttgatctcgatctcttcaaagaaccagcatttggttttattaacttatctagtatttctgtgatactgatctcattgatttctgttctttattttttttttctctttgctttcagtttactttgctcttttatttctagtttcttaaggtgaaaagttggatcatttatttgagacctttattttttaatataagcatatagtactcttgaattatctttaagcactgctttagctgtatcccacaaatgttgattttttttttttttcttcttgagacagggtcttgctgtgtcacccaggctggagtgcagtggtgcgatctcggttcacttcaaccaccgcctcctgggttcaaatgattctcacgcctcagtgccctgagtagctaggattacaggcacaaaccaccatgcctggctaattgtttgtatttttactagagacggtgttttagcatgttggccacgctggtctcaaactcctggcctcaagtgatccacccacctaggcctcccaaagtgctgaaattacaagtgtgagccaccacgcctggcattatttttccttttattcaattaaaaatgttttctcatttatttattttgtgatttctttgatcgatgagttatttgtaagtgtgcacttaatttcaaaatatttgagaactattcatttctcttttatgatttctagcttaactacattgtgtttagagaacacactttatatgatttcagttttcttaaatttgttgatatttattttatgtttgtagtatggtctgtcttggtatgtgttcttgaaaagaatttttttatttttgcaaaggaatgttctataaatgtcaggccaagctggttaatagtgttgtttatgtcttttgagagcagtgttgatattcctcattataattgtttatttgtggtttctcctttcagctctgtcggtttttgcttcatgtatcctgaagatctattattggccacatacacagttaggaattttgttttcttgaacagaccagttattatgtcatgtccttatctattccttgtaatattccttatcctcaagccttctttatcacatctgtagccactgcagatttctttgactcgtgtttctatagtatatctttttgcatctttttactttttaaatgtaaatatgtttatttaagtaggtttcttgaaggcagcgtgtagttggttcttgctattttatccaattctttagtctcttaagatgtttagaccgctcacatttaatgggatagttggatttaaatctaccattttgttctttctttgcattctctttgtcccacctcttttattcttctttccttatctttttggttacttattttgttatcattctattgtatttattcattttatcttcttttttctcttcttacctgctttgcaatggttttcttagggtttacaatgtaattctttaatttatcacggcctggcttcaaattgtattacaccccactccatgtttaatataagaacctcataactatatacttgcacttcctccctctcatattttgtactgctgttgtcatgttttacttctatatatgatgtaagccccagaatacatgtttaatgttttttgctttagcaaataaactcttttggagttttaaaatgagggaaaaaatgtcttttatatttatctgtactttttttcatttctttgtatagaattaaagtgctgtctgctattatacttctacccaaagaacttcctttaatgcttcttatagtacagattgactgacaataaattttctcagtttttgtctgaaaaagtctattttgtctttcacattgttcctttttaaaacaattttttaaagtgtagttgaatatataacatgagtcttaccattttccgtgtacagttagttcgttgacattaagtacatttacattgtttgcaaccattgccaccattcatctgcagaacgtttttcatcctgcaaaatggaaactctgtatactcttcattcctctttcccaccacccctgacaatcaccattcttctttctgttcctataaatttgatgattctaagtacatcatattagtgggatcatatagtacttgtccttttgtgactggcttattccacttggcattatgtcttcagggttcatgcatgttgcagaatgtataaaaatttcctttttaaggctgaacagtgttccattgtatgtatctaccctactttgttaattcatgtgttaatggataaatacattaggttgtttttaccttttggctattgtgaataatactgctgtgaacgtggctgtacaaatatctctttgtgtctctgttttcaaatattttaggtatatccccagaagtggaattactggattatatgataattctatttttaattttttaaggagctaccatactgttttccttagtggctgtgccattttgcattcccactaatggcgcaccaatgggtcaggcatgatggctcatccctgtaatcctatcactttgggaggctgaggacaggggttcgagacctgcctgggaaacagaacgagaccctatctctacaaaaaaattgaaaaactagtcgggcagatggcatatgcctgtagtcccagctacttgggagactgaggtgggaggattgcttgagcccaggagttggaggttacagtgagctataattgcaccacttaattccagcctggctcatagagcaagacctgtctccaaaaacaaaaatgaagtgcacaaaggttgaaatttctccacatttttgccaatacttgttattttctggtttttgatagtagtcaccctaatggatatatctttatcatttttaagaattatttttgctggatatagatttttcagttaataggggttttgtttcagttctttaaataaagatactatttctttattttctgtcttagaatgtctgctgccgttcttaatatttgttccattgtatatgatgttttccacctgtctggttgctttcaagatttttgcattaccaatttggctattgtatgcctagatttttttttctattgtatttactgtttgggtttctctcagcttcttagatgtatggtttgttgtcttcctttaattgtgaaaaatttccagttatttttaatgatatcttctgttccatgtggtttctctttggggctccaattttaaatgttagactttttgaattgcccaaagctcttaaatgctctattttttttgttcattcttttttctctttatgtttcatattggataatttttgtttacctagcttcaagttcactgatttcttagctgtgtctgcaaagcttagcaaaatatatattttttatcttggttagcatggattttcccctctggatttccaattgaatgtttttttagtttccatttctctgctgctagtcgccatctgtttatgcatgttgtaccatactctgccctctttactcctgtactctgacagtgggtatttacttcctgtgtttgtctctcctctgagtggattatcactctttggcattcagttcacctgtttgctttgtaacctccgctccctaatgagctcaagaaaagttacgattttgtaatttatcctgctttttctttcaccctgtcaggatgggaacagctttcttttgcaactttctacatcccaggtgaaagcaggacttttatcagtttatatacagagtttcaagatttcatataaagacaacttgagagcttttaaaagttcaaggaactaaatggaaagctattttaaagaaagtgagaagtttctaaaaaatgaaccctggaaacactcctgtagttctcagatcatacttgcttagtcatgatatagaggttaatatgggaatcactttcctgttttcttactctaataaggcagaaaacagtaatatttcagaggagatatggattagtttattatctttgcatggtccagttttggtacaccttggtaattaggaattttcttaaaaatctttacaccccacattatctatcttcactcctctttctcatataaagttacaatacataacattctgtatgcatgcttcacactttgcttttctgtcttgacaatgtgtaaatgagaatgtttgatattaccttacaaactgttttctactcagtaaatgtaacagcatctcctttcaatatgtttggaaaatctccattataaagagttaaaaataaaggaattcaaagagaaacctactttacacatgttagatttgagatgcttgtaagcgatgcaagtagaaatttcatgtgagaagttggatatacaagtctgaagcctcagtatctcagaattagaggtagaatttggaagagtcatcattatataaatggtatcaaaaccttggaattggaactggaacttctagcctggggagatgccaacattgagaggaaaggaataaaaatgagtgagtgggcagaaagtggaagaaaaccaggagagtatagtgacataggagccagtaaaagaatatatttcattcaactcaagaatgttcctaaatgtgggagtatgctgaatacagaattttaagtgaggactgtggacttaggtggtaggtttgggggtcattagctggcagatggttttagaagtcttcactgtgaatacctgtgggtaagtagataaagtgaagagaaagctgagagagccatgaaaggtaagcagagtaagttcatgaactgttacatttgaatttgtacaaaccaaatctttctatgtggttatcattaaaagcttgtaagcactgtaagtccatttatatttctattcctaaaggggttttaagcaaaaatgtttatatatttctggaattctgaattagaggagctttgatactttgcagctgacagttatcgtgacagtttgacagtatttaggtttatggtaattcatctaatccctttctgtagtctccaggatgcctttggaatgagctgttattcacctaaaattccgtgatactttagtaataggataggttttttgccacataccactgactagatctagatcttagagtctttttctataagctcttgcaagaaagaatcaagtgttgtttacattttctaacactgttatacccagtggcaaatgcaaagacataaacaaatactttagttatgatcagctcgtaggaagtgggaggaccccagctttatcttaaaatcattatgtatactggaaagaaattgattcaaatgcattcaccataaaactatggatggagaacctcattttattaatcacactaggacctatgccagcattgcttcatctttggcttttgttatatcctgttttgttaagttaaaaagcagttaaattttttttcacctacaccccattagtaaaaagaaattttcgaacactttcccatatgtgtatatataactgtttatatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtcagatggtgaaagtgctgaggagaaaaagaaaggataaggggacaaagtaactaggggtgatttttcaaaagggaagcgagggaagcccctctgacaaggcgataatttagatacggcctgagaaaacagagggagtgagccacataggtatgtggtaaaagtgcattccacacagagggaccagcaaacaccaaggctgcaagcagaggatcgcattaaccaaagatgtggtgctgagggtggaatgtgcctagtatggagaggtgggagataagatttaaataacagtgggagagcatgaaggggaacccaagtacatgaggccttgttggacatggtgaggactagggattttattatgggtgagaaggaagcctttggagggttttgaacaaataactaatgtgatctgacttatacttcagaaacgaaaaggagaggctgccctgggtgctgtgtagaatgtagcctgtggagaggcaagggaggagacgatgagctcccctgggaggctttagaagatcacagtggcttggacaaatgtggtagcaaatggagctagggtgaagtggagatttgtgttatgtttcaaaagtagagccaacaggatttgctgatggattggatatggggtgtgagaaagagaaacaagcattttggcccaagcaatgggaggaatgagttttccatgtactaagattgggaaaactgggaggggtatagctttgggttaaggaatctagagtttggttttagacatgttacatttgaggagcctaacagatattccagtggaggtggcaggaaggcaggtgaacatatgagcctgcagttcagtggaggtgatgtaaacctagctggctggagttgtaaatctagaacccaggcttcctgccttcctgcctggcactatttttcatcatgcctcctttctgtaacgaggctattttctgggatcactgcttgttaacagactgtatttaaagtacatttataattaactttttatttcttgaaaaatacattaatgagggttccatggtgtaatggttagcactctgtattctgaaaattacattaatacagaacttaaaaagcatgccctttcagcagtatctaattattcatataacttttctcttttgatgaaatattttgaattatattaatgatttaattaattgactattattgtgattgatatcattaattgtgaatcatttttgcactccttaaataaatctctaatgggcataagctattcgttaatatttcattggataatgtttgtatccagagtcataagtagtggtaatttaaattttgtgccaacattatcagaccttttttccctaatcattggcttcattaaatgaatttggattatttcttcttttctttcctctgtacacatttcaatattataaatttttttatattttctagtttcatagaattcaccagtaaaaatatctgaacctgcttctattttgaggaggggatcttggcagctttccctttttttttttctttcaccataattactgatctgttttaattttcagcttttttaaaaaatcaattttaaaagcttatattttcccagaaaatcactcatttaatttagattcccaaacttactagcctagagtcattttgtttcttataattattttaacatcctcagtgcctggggttattctgacctctatctcacttctattgcatatttatatattcttagcttgtattgttttgttatgtattttttccttcatttccttagattcattttggtcagaactttaatgtgtaattcattttaattttttttaataaggtttaagatagtttcttttttttttttttgagcagcagcaagatttattgtgaagagcaaaagaacaaagcttccacagcatggaaggggacccgagtggattgccctaagataatagatttttaatgcaactttgaccgtgtcccataagtcttctttacattttgtaattaaatttatttgccatatattcttcattcatgagggttttgtttagtttctcttttactttagtgttgtctatgaagaatttcaaatcttctgagggtttgggactttattcttttaacataatgatattgttgaatgagtgaaggaactcagccttgaaagatggaaaaatggaagagcaattgaaaagcaatgtgaaggtagccttgcaatggaaatgagcgtagcatgacagtgagccaagtggaaaattcatctcaggggagtggtcacaagtaaaatgggatagatagagtggaatcaaattgtatattgccatgcttaaatgacataccaggaggcctggatctttttctttagaaaacaaagaatttttgagaacagaaatttgttttcagtttctgtttttcagcatcattttcacctgtgatacagggcaagattattaataggcagggtttccaggcatttcatcatttgatgaaatctttttttttattattattatactttaagttttagggtacatgtgcacaatgtgcaggttagttacatatgtatacatgtgccgtgttggtgtgctgcacccagtaacaagtcatttaacattaggtatatctccaaatgctgtccttcccccctcccccaaccccacaacaggcccgggtgtgtgatgttccctttccctgtgtccatgtgttcccattgttcaattcccacctatgagtgacaacatgcggtgtttggttttttgtccttgaggtagtttgccgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcttttgggtatatacccagtaaagggattgctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcagtgtggttttgatttgcatttctttgatgactagtgatgatgagcattttttcatgtgtcttttggctgcataaatgtcttcttttgagaagtgtctgttcatatccctcgcccacttgttgatagggttgtttgtttttttcttgtaaatttgtttgagttcattgtagattctggatattagccctttgtcagatgagtagattgcaaaaatgttttcccattctgtaggttgcctgttcactctgatggtagtttcttttgctgtgcagaagctctttagtttaatgagatcccatttgtcaattttggcttttgttgccattgcttttggtgttttagacatgaagtccttgcacatgcctgtgttctgaatggtattgcctaggttttcttctagggtttttatggttttaggtctaacatttaagtctttaatccatcttgaattaatttttgtataaggtgtaaggaagagttccagtttcagctttctacatatggctagccagttttcccagcaccatttattaaatagggaatcgtttccccatttcttgtttttgtcaggtttgtcaaagatcagatggttgtagatatgccgcattattaaaattgacaccctaacattataactaaaagaactagagaagcaagagcaaacaaattcaaaagctagcagaaggcaagaaataactaagatcagagcagaactgaagggaatagagacacaaaaaaaccttcaaaaaatccatgaatccgggagctggtttttttgaaaagatcaacaaaattgatagactgctagcaagactaataaagaagaaaagagagaagaatcaaatagacgcaataaaaaatgataaaggcgatatcaccaccgatcccacagaaatgcaaactaccgtcagagaatactataaacacctctacgtaaataaaccagaaaatctagaagaaatggataaattcctcgacacatacaccctcccaagactaaaccaggaagaacttgaatctctgaataaaccaataacaggctctgaaattgaggcaataattaatagcttaccaactaaaaaaagtccaggaccagatggattcacagccgaattctaccagaggtacaaggaggagctgttaccattccttctgaaactattccaatcaatagaaaaagagggaatcctccctaactcattttatgaggccagcatcatcctgataccaaagccgggcagagacacaacaaaaaaagagaattttagaccaatatccctgatgaacatcgatgcaaacatcctcaataacatactggcaaaccaaatccagcagcacatcaaaaagcttatccaccacgacgaagttggcttcatccctgggatgcaagggtggttcaacatacgaaaatcaataaacttaatcccgcatgtaaacagaaccaaagacaaaaaccacatggttatctcagtagatgcagaaaaggcctttgacaaaattcaacaacacttcatgctaaaaactctcaataaattaggtattgatgggacgtatctcaaaataataagacctatttttgacaaacccacagctgatatcatactgaataggcaaaaactggaagcattgcctttgaaaactggcacaaggcagagatgctctctctcaccactcctattcaacatagtgttggaagttctggcgagggcaatcaggcaggagaaagaaataaagggtattcaattaggaaaagaagaagtcaaattgtccctgtttgcagatgacatgattgtatatctagaaaaccccattgtctcagcccaaaatctccttaagctgataggcaacttcagcaaagtctcagaatacacaatcaatgtgcaaaaatcacaatcattcttatacaccaataacagacaaacagagagccaaatcatgagtgaactcccattcacaattgcttcaaagagaataaaatacctaggaatccaacttacaagggaggtgaaggacttcttcaaggagaactacaaaccactgctcgatgaaataaaagagaatacaaacaaatggaagaacattccatggtcatgggtaggaagaatcgatattgtgaaaatggctatactgcccaaggtaatttatagattcaatgccatccccatcaagctaccaatgagtttcttcaaagaattggaaaaaactattttaaagttcatatggaaccaaaaaagaacccgcattgccaagtcaatcctaagccaaaagaacaaagctggaggcatcacgctacctgacttcaaactatagtacaaggctacagtaaccaaaacagcatggtactggtaccaaaacagagatatagaccaatggaacagatatctcttttaaatagggatgtcatgtattgagggcctgctgatatatatcccagagctgggctagaaagtaaggaataatgtgatctaatattattacctgtttccactctcctcctcccctcaagatcatgttcgttatcatatgaggtaggaagtacaacagacattaaataacttcttgcaatcaggaaagaaagccctttttccccaccatgatataaaggatcaaaacatgtacctcatcagaatttcttcaaacttgcttcaaaaaggtggtatgtttaattattcttggcaaacataaaagataattgacacagaactccataccattttttcaaacgaaatttttatttattttctcttatctagctatgttcactttggaaaatgcacaatgattttatttttctgtaaccgccttggtctaaagctgcttttttagtaacatttttctttttctatttctagcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggtatgtcttaagaaagagtgtgctttcaaaatgttagcatatacttttggataattactttctgataaagttgtgacgtaatctagtcagactgtgatttttgtgtgtgtgaaggggagagttatttcatcaagtgattgtcacatatatataggtttttaaagtttttatccaagtatgacccattgtaagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcggccaggcgcggtgtctcacgcctgtaatgccagcgctttgggaggccgaggtgggtggatcccgaggtcaggagattgagaccaacctggccaacgtggtgtaaccccatctctactaaaaatacgaaaattagctgagtgtggtggcgcgtgcctgtaattccagctactcgggaggctgaggaacaagaatcacttgaacccaggaggcagaggttgcagtgagccgagattgcgccaccgtactccagcctggcaacagaatgagactccatctcaaaaaagaaatggacgtaatgttccagaggcaaagttactttattttttcaggatttcttgaaaagcagtttttgtaactccaatgtgtaggaatcttatttcaccaaaaaatagtacatcgaataggcaagaacacaggcagtagggcagctttgacagcctcagtaatttccaagggtattttttgacagaagtatcacaagtcttaaagtgattgcatcgaaaatttctgattcatttgggtaagtgattatctttccatttgccaaggacctgttgtatgtatagtggtagaacaatttgtatatttataagggagatatgaggtagaacgtaagacttctttggggagccgacagtacataaatgtgtagaccttcttgctcaaaagaaataagtgcaagttaatctggttttaaaagcatacccataaatactgagtttacttggaattttagaggtagatataattaaaggtgaacctactagaatcaatatttttaggtctttcttccctcctctttgaaaagatttgcagaaagtgtttgatcgataaaaatgcaattgttaattgaaaaatgaggctgcacatggtggctcatgcccgtaatcccaacactttgggaggctgaggcaggcagatcacttgaggtcaggaatttgagaccagcctggccaacatggcgaaaccccatttctactaaaaatacaaaaattagctgggcatggtggcacacacctattatctgaactattcgcgtgacggaggcatgagaattgcttgaacctgggaggcagaggttgcagtgagctgagattgtgccatttgcactgcagcctggatgacagagcaagacactgtatctcaaaaaaaaaaaaaaaaaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttattgtagagctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggactcagggtttgctgagctatggctgcccgttagcttctcattctacctgcttctctttcccaccctgctctcttcactcttgttcttacgctatgccaggcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctctctccttgcttttactgtttacctttcttttttcctgtctaatcattcacttctttacctcccctttgtctttttctcccgcaaagttaccagaaaggagggtttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagagatctgagctcctgcaaaattagttttttgttgaagtggtttatcttgtaagcatgattatcttaaaaacttaaatgttggattgtttaaacggtggcttaaaaactaaatattttagataggctctatagagatatgttcatttagctgctgtggatgaataggcattaaaaataagtatgcaccaagtagaaaccctgagtgtgtgtgtgtgtgtgtgtatgtgtgtgtgtgttcttcacgtccaatatagattttgactcaattccaagttaagcaagattatattgaattcagctttactgtgcaaaaaacagcatctgcctgagtgtccacgtatagtagtgagtcacctttggtaataaatgcattttctgtcctgtgctttaatgtggttatattttaccgcatcccccaaaaagggtagacagtaaatgttacatttatggaatagtagtgccattttatacagtttgagtctcgtcagtatttctacatcaagctttgtactatggcttatttaaaaagtagaatgtttatgtatttaaacagataaaatttagaatgattttaattccagggtaaaatctgctccgaccagagagaaaaaactaattcatatatgaatatagtatttgtaatcctcttgtttaaagacatgcaagttctagaagtatttgtactgcttaatgttttaacaactctaacaataatagcagcgggcatactttgtaccagtttttgctgtaagccttttatatatattaatcctctttaaaaccaccctatcaagtacaagataataatttgatatggttgatgaagcaactgatgggaaaaaagagaggttaaataatttgccccaaatcttattaagtgatgtagccagcatctgaacccaatcagactgtagactagagcctcctcccaaccactcagctttgctgcttcccacatactagttacataactactgtatgactatagaggtcaggttatcagccttctagaatcagtaatgttttctgtcaaaaaaaaaaaaaaaagaaacttgagaagcagctcctggattttcagaaattaacaagaagaatagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgtgtggtttcagttacccgtggtcaaccacagttgaaaatagatgagtactgtacaagctattttgagagagaccacattcacatgatttttagagttataattgttctgttttattattagttattgttaatctcttaccatgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatgggatagcctgctacacgcctaggctttgtatggtacaaacctgcagtacagcctattactgtactgaatagtataaggaaatagtgatacaatggtacgtatttgtgtgataggaatttttcagctccattttaatcttatgggaccactgtcatatatttatgtctttgtcttaagtgtccttatgcggcacatgactgcatgtatagagttcagtactatctgccatttcaggcacctactgtgggtctttgaagtatcccctgcagataaggggggactactgtatgcaactgggagaaaaaaagggttaagaaagaagagacctgagtcaaacgggagagtactctgccaaagaagcagtgaagattccccgaggaatgtgaggttgtggtcttagcaagtaggcagtggataagagaacctgcagcaaagaaaccaaggctctctacctggtgaggcaggagtagtctttttgaaaagactgtgggatcatggacaggttgagctctggattctcactaagagacatactatccagtacacacttccctctgatcgtcacttggctggctttttttcatcattggtttctcagttcagttgctaatttcttaggccttctgcagcttctgtagctgaaatagtttcctaacactctttatctcattaccctgttttattgtcttcatatggtttattagtctttgaaattaccttgtttatttatttgttcacccttctgtgttccctactgtctgatgttcactgtccattgccatttatctaattctagaagagtgcttgggatacagtagttgcttggtgaatttattttaaaacaaatttcagtaaaacttgtttcattgaaattaatttttcaagagtttgtggctctctgcagattcatccatgaaccccaagttaagaatatctgtactacgcatttacttcttgaccctctgtaatcccaaggatgccactgtgggggctgtaggcataccccagccaagttcaagttggtattccttgaataaagtaatgtagtgacacaccttggatcctgtgttattcttaattcttcattacttataacagtattaaaaggcagaggcatagtttaccttataagtacccagtaaatttttttaatgaatagcaaggcattcgatgtattgtagaaatatttagtggtcattttttattctttcagctggatgcttcaggtaacatgtactttgattttgagtccacattgccaggagatcccagtgatgattacaaatttataaaaccaacgatccttctcagattccatacctatttcagacttactagagttcactgacaggaatttcctgttgatgtatttaggatctacagagtttttgtttttagtatgtgtgcgtgcaatctacttattaaagtgagtttttttcatttgtggtaattgtgtggtagttcatcaggatatgttgagatcatctgcctttaaaaaatgccttttaaagttcatatatgtgtcttttcaaatcatgtgaacaattacattgcttaagggaggaaaaatgcttttatagattattctctctcccgttattccaagaactgtataagtcaaaattcatctcattttttaccttgaatccaaatagttttataaataaccacatccaaatagcatacacctgtaattgtttctgttggcagtacgttacagtaatgtgtttttagatttttgatatttttaaagactttcaattttaaaaaattaaatcatctatgaattaaagttagttatcaactgtgattgtaatagtgcctatgttgcctatgtaatacaaaatattaagtaaattccacatttattttatctacccaaatgacagtgacctcatttttctgtacccttcctcttaagttaattcgttattaattttttatatatgatgactcaacctctgttcccttgcttttaagcactgaaaaataaaaattaacagaaatgtggttaattccaagtacaagtgagaggaaaatttaactaatatgtcatctgtcttgtcttctgtaagatttttagaaatcgctgtggtcaagagtgatatgaatcaagtacatccttatattccttgtggcagtgtaaattggactagctcattcaggaaatgatttagctataggatcaagaaccaaaagaagtctattctctagggcactataattccacttctgaaaatttacctgaaataattcagaagaaaccgtgaaccaaattataacactgggaaataaccaagtaaattaggcaggtgcagtctttaggaacaaacattaaaaaatcatttctgaaggctgacaacacagaagatacatataatattgaacaattaaatataaaatttattttttataaccattgtgtggggttgagattgtggataaagatgaagcaaactctgaaagataaaaacggaatgttggttgtgggattgtgggtatactactttggttgccattggataatttatttaaaacacacagattggccaggcatggtggctcatacctgtaatcccaccactttgggaggccgaggtgggtggatcacttgagttcaggagttggagaccagcctgaccaacatggtgaaaccccatctctactaaaaatataaaaaattagctgggcgtggcggtgggtgcctgaaatctcagctactcaggacgctgaggcaagagaattgcttgaacctgggagatggaggttgcaataggccataatcacaccactgcactccagccagggcaacagagtgagacttctcaaaaaaaaaaaaaaaaaaaaaactaaaaaacactagattgaccagaatggattcttgtattttttttcttaccataaagttttataggcaaaatagaaaatttcattttgcatataggaaactctaaagcattttgcataataattgatggtacacagggtaattcccacatttgaaaaattgttaaaggaagtgatttttctagagttttgattaacagctttagtttcttgaattatctgtgctcttgtttgttcttataattagagaaaattatttttatataggtaacaaaatcaaatcaaggcatatcagagatgagagtatatgatgtacaaatatttcaagtgacaagatcaactgtataacattttgttggttgtcctattctgtttgtatttttctcaggctctatcaaagaaagcaagagatggaaaattgttgcctgaagaataccaaggaggatcttttaggtaaaatttaaactcttaattatccatagcatcaaacagatagatgtaagacttataaagtccctgtcagcctttcatttatctgaaatattttttaaaatttaagctaaaaatactttatttagacaatagaatatctgaaaaaattcttcagactagtcaggctttcatattaaagctagtaggaacctattagtgttgaactaaacgttcgttggacattgactaacatggaatgataaatattatgtattctttagtatctgacccacccccaatattaatgtctgtaatattatattgctatgtgaaacaaccacttatttattattgcagcatataatattctattgtataaatataccagaattcattttactgttggtgggcatttgcgttgcttccagttcggggctattacaaattatggtgctatgaacattcttattagtgtcttatagtgaatgtatgtacattttttgttgtatagacctaaaagtagaattcctaagttagaagctttagcagctactaccaaacaattttccaaatggttatacaaatttacacctccaccaacggtcctgagaattcccattgctccacattcttgccactatttaataatgttaggttttaaattttaacaattcttggggtgtgtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacgttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcgtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatcatgcaaacatcatagagtgtacttacgcaaatcatgcaaacatcatagagtgtacttacacaaacctaaatggtacatgctgctacacaccttagctgtatgatatagccagttgctcctagactgcaaacctatacagcatgttactctactgaataccgtaagcagttgtgacacaatgatgagtatttgggtatctaaacatatctaagcatttttaaaatgtacagtaaaaatgtaaaaagtaaaacatggtacacctgtttagggcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatgatgccactaggcagcagaaattcctgagctccattataatcttataagaccaccgttgtatatgtgatccttcgttatgtgggacatgactcgatataaaatggattgttatattgaccttttatctgatgacttaactaaatttacttattaattttactagttatctatagtctcatttttcctgtgtacacaattaatttatttgtaaatactaaatgtttccttttttcattactcatatatttttttcttgccttactacactgcctagtaaaatatataaaatatgtgcttcacggaaaggggactttgattaaggacatgcctccttcagagctttttcttttccccctagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttga

SEQ ID NO: 9525 - DNA, 18479 bp, Homo sapiens
atatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtcagatggtgaaagtgctgaggagaaaaagaaaggataaggggacaaagtaactaggggtgatttttcaaaagggaagcgagggaagcccctctgacaaggcgataatttagatacggcctgagaaaacagagggagtgagccacataggtatgtggtaaaagtgcattccacacagagggaccagcaaacaccaaggctgcaagcagaggatcgcattaaccaaagatgtggtgctgagggtggaatgtgcctagtatggagaggtgggagataagatttaaataacagtgggagagcatgaaggggaacccaagtacatgaggccttgttggacatggtgaggactagggattttattatgggtgagaaggaagcctttggagggttttgaacaaataactaatgtgatctgacttatacttcagaaacgaaaaggagaggctgccctgggtgctgtgtagaatgtagcctgtggagaggcaagggaggagacgatgagctcccctgggaggctttagaagatcacagtggcttggacaaatgtggtagcaaatggagctagggtgaagtggagatttgtgttatgtttcaaaagtagagccaacaggatttgctgatggattggatatggggtgtgagaaagagaaacaagcattttggcccaagcaatgggaggaatgagttttccatgtactaagattgggaaaactgggaggggtatagctttgggttaaggaatctagagtttggttttagacatgttacatttgaggagcctaacagatattccagtggaggtggcaggaaggcaggtgaacatatgagcctgcagttcagtggaggtgatgtaaacctagctggctggagttgtaaatctagaacccaggcttcctgccttcctgcctggcactatttttcatcatgcctcctttctgtaacgaggctattttctgggatcactgcttgttaacagactgtatttaaagtacatttataattaactttttatttcttgaaaaatacattaatgagggttccatggtgtaatggttagcactctgtattctgaaaattacattaatacagaacttaaaaagcatgccctttcagcagtatctaattattcatataacttttctcttttgatgaaatattttgaattatattaatgatttaattaattgactattattgtgattgatatcattaattgtgaatcatttttgcactccttaaataaatctctaatgggcataagctattcgttaatatttcattggataatgtttgtatccagagtcataagtagtggtaatttaaattttgtgccaacattatcagaccttttttccctaatcattggcttcattaaatgaatttggattatttcttcttttctttcctctgtacacatttcaatattataaatttttttatattttctagtttcatagaattcaccagtaaaaatatctgaacctgcttctattttgaggaggggatcttggcagctttccctttttttttttctttcaccataattactgatctgttttaattttcagcttttttaaaaaatcaattttaaaagcttatattttcccagaaaatcactcatttaatttagattcccaaacttactagcctagagtcattttgtttcttataattattttaacatcctcagtgcctggggttattctgacctctatctcacttctattgcatatttatatattcttagcttgtattgttttgttatgtattttttccttcatttccttagattcattttggtcagaactttaatgtgtaattcattttaattttttttaataaggtttaagatagtttcttttttttttttttgagcagcagcaagatttattgtgaagagcaaaagaacaaagcttccacagcatggaaggggacccgagtggattgccctaagataatagatttttaatgcaactttgaccgtgtcccataagtcttctttacattttgtaattaaatttatttgccatatattcttcattcatgagggttttgtttagtttctcttttactttagtgttgtctatgaagaatttcaaatcttctgagggtttgggactttattcttttaacataatgatattgttgaatgagtgaaggaactcagccttgaaagatggaaaaatggaagagcaattgaaaagcaatgtgaaggtagccttgcaatggaaatgagcgtagcatgacagtgagccaagtggaaaattcatctcaggggagtggtcacaagtaaaatgggatagatagagtggaatcaaattgtatattgccatgcttaaatgacataccaggaggcctggatctttttctttagaaaacaaagaatttttgagaacagaaatttgttttcagtttctgtttttcagcatcattttcacctgtgatacagggcaagattattaataggcagggtttccaggcatttcatcatttgatgaaatctttttttttattattattatactttaagttttagggtacatgtgcacaatgtgcaggttagttacatatgtatacatgtgccgtgttggtgtgctgcacccagtaacaagtcatttaacattaggtatatctccaaatgctgtccttcccccctcccccaaccccacaacaggcccgggtgtgtgatgttccctttccctgtgtccatgtgttcccattgttcaattcccacctatgagtgacaacatgcggtgtttggttttttgtccttgaggtagtttgccgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcttttgggtatatacccagtaaagggattgctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcagtgtggttttgatttgcatttctttgatgactagtgatgatgagcattttttcatgtgtcttttggctgcataaatgtcttcttttgagaagtgtctgttcatatccctcgcccacttgttgatagggttgtttgtttttttcttgtaaatttgtttgagttcattgtagattctggatattagccctttgtcagatgagtagattgcaaaaatgttttcccattctgtaggttgcctgttcactctgatggtagtttcttttgctgtgcagaagctctttagtttaatgagatcccatttgtcaattttggcttttgttgccattgcttttggtgttttagacatgaagtccttgcacatgcctgtgttctgaatggtattgcctaggttttcttctagggtttttatggttttaggtctaacatttaagtctttaatccatcttgaattaatttttgtataaggtgtaaggaagagttccagtttcagctttctacatatggctagccagttttcccagcaccatttattaaatagggaatcgtttccccatttcttgtttttgtcaggtttgtcaaagatcagatggttgtagatatgccgcattattaaaattgacaccctaacattataactaaaagaactagagaagcaagagcaaacaaattcaaaagctagcagaaggcaagaaataactaagatcagagcagaactgaagggaatagagacacaaaaaaaccttcaaaaaatccatgaatccgggagctggtttttttgaaaagatcaacaaaattgatagactgctagcaagactaataaagaagaaaagagagaagaatcaaatagacgcaataaaaaatgataaaggcgatatcaccaccgatcccacagaaatgcaaactaccgtcagagaatactataaacacctctacgtaaataaaccagaaaatctagaagaaatggataaattcctcgacacatacaccctcccaagactaaaccaggaagaacttgaatctctgaataaaccaataacaggctctgaaattgaggcaataattaatagcttaccaactaaaaaaagtccaggaccagatggattcacagccgaattctaccagaggtacaaggaggagctgttaccattccttctgaaactattccaatcaatagaaaaagagggaatcctccctaactcattttatgaggccagcatcatcctgataccaaagccgggcagagacacaacaaaaaaagagaattttagaccaatatccctgatgaacatcgatgcaaacatcctcaataacatactggcaaaccaaatccagcagcacatcaaaaagcttatccaccacgacgaagttggcttcatccctgggatgcaagggtggttcaacatacgaaaatcaataaacttaatcccgcatgtaaacagaaccaaagacaaaaaccacatggttatctcagtagatgcagaaaaggcctttgacaaaattcaacaacacttcatgctaaaaactctcaataaattaggtattgatgggacgtatctcaaaataataagacctatttttgacaaacccacagctgatatcatactgaataggcaaaaactggaagcattgcctttgaaaactggcacaaggcagagatgctctctctcaccactcctattcaacatagtgttggaagttctggcgagggcaatcaggcaggagaaagaaataaagggtattcaattaggaaaagaagaagtcaaattgtccctgtttgcagatgacatgattgtatatctagaaaaccccattgtctcagcccaaaatctccttaagctgataggcaacttcagcaaagtctcagaatacacaatcaatgtgcaaaaatcacaatcattcttatacaccaataacagacaaacagagagccaaatcatgagtgaactcccattcacaattgcttcaaagagaataaaatacctaggaatccaacttacaagggaggtgaaggacttcttcaaggagaactacaaaccactgctcgatgaaataaaagagaatacaaacaaatggaagaacattccatggtcatgggtaggaagaatcgatattgtgaaaatggctatactgcccaaggtaatttatagattcaatgccatccccatcaagctaccaatgagtttcttcaaagaattggaaaaaactattttaaagttcatatggaaccaaaaaagaacccgcattgccaagtcaatcctaagccaaaagaacaaagctggaggcatcacgctacctgacttcaaactatagtacaaggctacagtaaccaaaacagcatggtactggtaccaaaacagagatatagaccaatggaacagatatctcttttaaatagggatgtcatgtattgagggcctgctgatatatatcccagagctgggctagaaagtaaggaataatgtgatctaatattattacctgtttccactctcctcctcccctcaagatcatgttcgttatcatatgaggtaggaagtacaacagacattaaataacttcttgcaatcaggaaagaaagccctttttccccaccatgatataaaggatcaaaacatgtacctcatcagaatttcttcaaacttgcttcaaaaaggtggtatgtttaattattcttggcaaacataaaagataattgacacagaactccataccattttttcaaacgaaatttttatttattttctcttatctagctatgttcactttggaaaatgcacaatgattttatttttctgtaaccgccttggtctaaagctgcttttttagtaacatttttctttttctatttctagcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggtatgtcttaagaaagagtgtgctttcaaaatgttagcatatacttttggataattactttctgataaagttgtgacgtaatctagtcagactgtgatttttgtgtgtgtgaaggggagagttatttcatcaagtgattgtcacatatatataggtttttaaagtttttatccaagtatgacccattgtaagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcggccaggcgcggtgtctcacgcctgtaatgccagcgctttgggaggccgaggtgggtggatcccgaggtcaggagattgagaccaacctggccaacgtggtgtaaccccatctctactaaaaatacgaaaattagctgagtgtggtggcgcgtgcctgtaattccagctactcgggaggctgaggaacaagaatcacttgaacccaggaggcagaggttgcagtgagccgagattgcgccaccgtactccagcctggcaacagaatgagactccatctcaaaaaagaaatggacgtaatgttccagaggcaaagttactttattttttcaggatttcttgaaaagcagtttttgtaactccaatgtgtaggaatcttatttcaccaaaaaatagtacatcgaataggcaagaacacaggcagtagggcagctttgacagcctcagtaatttccaagggtattttttgacagaagtatcacaagtcttaaagtgattgcatcgaaaatttctgattcatttgggtaagtgattatctttccatttgccaaggacctgttgtatgtatagtggtagaacaatttgtatatttataagggagatatgaggtagaacgtaagacttctttggggagccgacagtacataaatgtgtagaccttcttgctcaaaagaaataagtgcaagttaatctggttttaaaagcatacccataaatactgagtttacttggaattttagaggtagatataattaaaggtgaacctactagaatcaatatttttaggtctttcttccctcctctttgaaaagatttgcagaaagtgtttgatcgataaaaatgcaattgttaattgaaaaatgaggctgcacatggtggctcatgcccgtaatcccaacactttgggaggctgaggcaggcagatcacttgaggtcaggaatttgagaccagcctggccaacatggcgaaaccccatttctactaaaaatacaaaaattagctgggcatggtggcacacacctattatctgaactattcgcgtgacggaggcatgagaattgcttgaacctgggaggcagaggttgcagtgagctgagattgtgccatttgcactgcagcctggatgacagagcaagacactgtatctcaaaaaaaaaaaaaaaaaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttattgtagagctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggactcagggtttgctgagctatggctgcccgttagcttctcattctacctgcttctctttcccaccctgctctcttcactcttgttcttacgctatgccaggcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctctctccttgcttttactgtttacctttcttttttcctgtctaatcattcacttctttacctcccctttgtctttttctcccgcaaagttaccagaaaggagggtttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagagatctgagctcctgcaaaattagttttttgttgaagtggtttatcttgtaagcatgattatcttaaaaacttaaatgttggattgtttaaacggtggcttaaaaactaaatattttagataggctctatagagatatgttcatttagctgctgtggatgaataggcattaaaaataagtatgcaccaagtagaaaccctgagtgtgtgtgtgtgtgtgtgtatgtgtgtgtgtgttcttcacgtccaatatagattttgactcaattccaagttaagcaagattatattgaattcagctttactgtgcaaaaaacagcatctgcctgagtgtccacgtatagtagtgagtcacctttggtaataaatgcattttctgtcctgtgctttaatgtggttatattttaccgcatcccccaaaaagggtagacagtaaatgttacatttatggaatagtagtgccattttatacagtttgagtctcgtcagtatttctacatcaagctttgtactatggcttatttaaaaagtagaatgtttatgtatttaaacagataaaatttagaatgattttaattccagggtaaaatctgctccgaccagagagaaaaaactaattcatatatgaatatagtatttgtaatcctcttgtttaaagacatgcaagttctagaagtatttgtactgcttaatgttttaacaactctaacaataatagcagcgggcatactttgtaccagtttttgctgtaagccttttatatatattaatcctctttaaaaccaccctatcaagtacaagataataatttgatatggttgatgaagcaactgatgggaaaaaagagaggttaaataatttgccccaaatcttattaagtgatgtagccagcatctgaacccaatcagactgtagactagagcctcctcccaaccactcagctttgctgcttcccacatactagttacataactactgtatgactatagaggtcaggttatcagccttctagaatcagtaatgttttctgtcaaaaaaaaaaaaaaaagaaacttgagaagcagctcctggattttcagaaattaacaagaagaatagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgtgtggtttcagttacccgtggtcaaccacagttgaaaatagatgagtactgtacaagctattttgagagagaccacattcacatgatttttagagttataattgttctgttttattattagttattgttaatctcttaccatgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatgggatagcctgctacacgcctaggctttgtatggtacaaacctgcagtacagcctattactgtactgaatagtataaggaaatagtgatacaatggtacgtatttgtgtgataggaatttttcagctccattttaatcttatgggaccactgtcatatatttatgtctttgtcttaagtgtccttatgcggcacatgactgcatgtatagagttcagtactatctgccatttcaggcacctactgtgggtctttgaagtatcccctgcagataaggggggactactgtatgcaactgggagaaaaaaagggttaagaaagaagagacctgagtcaaacgggagagtactctgccaaagaagcagtgaagattccccgaggaatgtgaggttgtggtcttagcaagtaggcagtggataagagaacctgcagcaaagaaaccaaggctctctacctggtgaggcaggagtagtctttttgaaaagactgtgggatcatggacaggttgagctctggattctcactaagagacatactatccagtacacacttccctctgatcgtcacttggctggctttttttcatcattggtttctcagttcagttgctaatttcttaggccttctgcagcttctgtagctgaaatagtttcctaacactctttatctcattaccctgttttattgtcttcatatggtttattagtctttgaaattaccttgtttatttatttgttcacccttctgtgttccctactgtctgatgttcactgtccattgccatttatctaattctagaagagtgcttgggatacagtagttgcttggtgaatttattttaaaacaaatttcagtaaaacttgtttcattgaaattaatttttcaagagtttgtggctctctgcagattcatccatgaaccccaagttaagaatatctgtactacgcatttacttcttgaccctctgtaatcccaaggatgccactgtgggggctgtaggcataccccagccaagttcaagttggtattccttgaataaagtaatgtagtgacacaccttggatcctgtgttattcttaattcttcattacttataacagtattaaaaggcagaggcatagtttaccttataagtacccagtaaatttttttaatgaatagcaaggcattcgatgtattgtagaaatatttagtggtcattttttattctttcagctggatgcttcaggtaacatgtactttgattttgagtccacattgccaggagatcccagtgatgattacaaatttataaaaccaacgatccttctcagattccatacctatttcagacttactagagttcactgacaggaatttcctgttgatgtatttaggatctacagagtttttgtttttagtatgtgtgcgtgcaatctacttattaaagtgagtttttttcatttgtggtaattgtgtggtagttcatcaggatatgttgagatcatctgcctttaaaaaatgccttttaaagttcatatatgtgtcttttcaaatcatgtgaacaattacattgcttaagggaggaaaaatgcttttatagattattctctctcccgttattccaagaactgtataagtcaaaattcatctcattttttaccttgaatccaaatagttttataaataaccacatccaaatagcatacacctgtaattgtttctgttggcagtacgttacagtaatgtgtttttagatttttgatatttttaaagactttcaattttaaaaaattaaatcatctatgaattaaagttagttatcaactgtgattgtaatagtgcctatgttgcctatgtaatacaaaatattaagtaaattccacatttattttatctacccaaatgacagtgacctcatttttctgtacccttcctcttaagttaattcgttattaattttttatatatgatgactcaacctctgttcccttgcttttaagcactgaaaaataaaaattaacagaaatgtggttaattccaagtacaagtgagaggaaaatttaactaatatgtcatctgtcttgtcttctgtaagatttttagaaatcgctgtggtcaagagtgatatgaatcaagtacatccttatattccttgtggcagtgtaaattggactagctcattcaggaaatgatttagctataggatcaagaaccaaaagaagtctattctctagggcactataattccacttctgaaaatttacctgaaataattcagaagaaaccgtgaaccaaattataacactgggaaataaccaagtaaattaggcaggtgcagtctttaggaacaaacattaaaaaatcatttctgaaggctgacaacacagaagatacatataatattgaacaattaaatataaaatttattttttataaccattgtgtggggttgagattgtggataaagatgaagcaaactctgaaagataaaaacggaatgttggttgtgggattgtgggtatactactttggttgccattggataatttatttaaaacacacagattggccaggcatggtggctcatacctgtaatcccaccactttgggaggccgaggtgggtggatcacttgagttcaggagttggagaccagcctgaccaacatggtgaaaccccatctctactaaaaatataaaaaattagctgggcgtggcggtgggtgcctgaaatctcagctactcaggacgctgaggcaagagaattgcttgaacctgggagatggaggttgcaataggccataatcacaccactgcactccagccagggcaacagagtgagacttctcaaaaaaaaaaaaaaaaaaaaaactaaaaaacactagattgaccagaatggattcttgtattttttttcttaccataaagttttataggcaaaatagaaaatttcattttgcatataggaaactctaaagcattttgcataataattgatggtacacagggtaattcccacatttgaaaaattgttaaaggaagtgatttttctagagttttgattaacagctttagtttcttgaattatctgtgctcttgtttgttcttataattagagaaaattatttttatataggtaacaaaatcaaatcaaggcatatcagagatgagagtatatgatgtacaaatatttcaagtgacaagatcaactgtataacattttgttggttgtcctattctgtttgtatttttctcaggctctatcaaagaaagcaagagatggaaaattgttgcctgaagaataccaaggaggatcttttaggtaaaatttaaactcttaattatccatagcatcaaacagatagatgtaagacttataaagtccctgtcagcctttcatttatctgaaatattttttaaaatttaagctaaaaatactttatttagacaatagaatatctgaaaaaattcttcagactagtcaggctttcatattaaagctagtaggaacctattagtgttgaactaaacgttcgttggacattgactaacatggaatgataaatattatgtattctttagtatctgacccacccccaatattaatgtctgtaatattatattgctatgtgaaacaaccacttatttattattgcagcatataatattctattgtataaatataccagaattcattttactgttggtgggcatttgcgttgcttccagttcggggctattacaaattatggtgctatgaacattcttattagtgtcttatagtgaatgtatgtacattttttgttgtatagacctaaaagtagaattcctaagttagaagctttagcagctactaccaaacaattttccaaatggttatacaaatttacacctccaccaacggtcctgagaattcccattgctccacattcttgccactatttaataatgttaggttttaaattttaacaattcttggggtgtgtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacgttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcgtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatcatgcaaacatcatagagtgtacttacgcaaatcatgcaaacatcatagagtgtacttacacaaacctaaatggtacatgctgctacacaccttagctgtatgatatagccagttgctcctagactgcaaacctatacagcatgttactctactgaataccgtaagcagttgtgacacaatgatgagtatttgggtatctaaacatatctaagcatttttaaaatgtacagtaaaaatgtaaaaagtaaaacatggtacacctgtttagggcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatgatgccactaggcagcagaaattcctgagctccattataatcttataagaccaccgttgtatatgtgatccttcgttatgtgggacatgactcgatataaaatggattgttatattgaccttttatctgatgacttaactaaatttacttattaattttactagttatctatagtctcatttttcctgtgtacacaattaatttatttgtaaatactaaatgtttccttttttcattactcatatatttttttcttgccttactacactgcctagtaaaatatataaaatatgtgcttcacggaaaggggactttgattaaggacatgcctccttcagagctttttcttttccccctagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttga

SEQ ID NO: 9526 - DNA, 716 bp, Homo sapiens
ataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttagttacattcactattttgtgctaaatttaagtcattggtatacgactggccagagtccttggttttaaacattactgagaactttatatatactcttaatgggtattttatataatgtcgaatgaaacttttatttttagatttttaaaaaatattttgcactttggacttaattttacactaaattgtatcagccagcctaagggcattatgctaaatgtaaatctagttcttggttaagcttttattgaaagataggtggtgctgtaagttaatatattgtagtgaaagtgtgggagaaaagttaaattggcacttaaatcttagttttcaaggaaaacgtgtcccgcacatactgcattatgatggactttgtctcaggtgaagtgaagaagtgaaagaatcaagtgtatggcc

SEQ ID NO: 9527 - DNA, 716 bp, Homo sapiens; identical to SEQ ID NO: 9526

SEQ ID NO: 9528 - DNA, 2625 bp, Homo sapiens
gaggcaggcagatcacaaggtcaggagatcgagaccatcctagctaacacagtgaaaccccatctctattaaaaatacaaaaaatgagccgggcatggtggcgggcgcctatagtcccagctactcgggaggcagaggcaggagaatggcgtgaacccaggaggcagagctttcagtgagccgagatcgcgccactgcactccagcctgggccacagagcgagactccatctcaaaaaaaaaaaaaaaaagacataatgatataacctcattttcttctatgttttcctgctttcctaccaatatctgtaaaacattaacgtcattatttaaaaaaatatgtaacctagataatatagtaatcagacatcattgttaaatttacagcttaaggaagtaagttgtcttttcaatcagattagtcattctgtttttttagtaatagttatatattaatgaagtgaaactttataggtaggtatacatcaatgaaatcttaggcttttaccatctatattgcatacttctgacattatatcttattttccttaggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttctttattgcgactattccttttttcccccagaattagtgctttggtttaggtctttgtctagcttaactacttccaattgattcttcagccttttcttttaggtttacttactataaaagtctcagaagaaagcataaggggaaagcttcgtgacattgtatttggcaatgatttcttgaatatgacaacagaagcacaggcaacaaaagaaaaaatagataaattgaatttcatcaaaatttcaaatttttgtgcattaaaagatgcagtgaaaaggcaacacagagaatgggagaaaatatttgcaaatcatatatctgataactgtctagtgtccagaatatataaagcactcctacaactcaaccaccaaaaaacaacccaataaaaattagcaaaggggctgggcatggtggctcatgcctgtaatcctagcactttgggaggctgaggcagtcagatcacctgaggccaggagttcaagaccagccgagccaagatggcgaaaccccatctctactaagaatacaaaaaattggcctggcgcagtggctcacgcctgtaatcccagcactttgggaggccgaggtgggtgggtcacctgaggttaggagttcaagatcagcctggccaagatggtgaaacccccgtctctactaaaaatacaaaaaattagttgggcatggtggcgggcacctgtactcccagctactcgggaggctgaggcagagaattgcttgaacctgggaggcggaggttgtagtgagcc

SEQ ID NO: 9529 - DNA, 2625 bp, Homo sapiens
gaggcaggcagatcacaaggtcaggagatcgagaccatcctagctaacacagtgaaaccccatctctattaaaaatacaaaaaatgagccgggcatggtggcgggcgcctatagtcccagctactcgggaggcagaggcaggagaatggcgtgaacccaggaggcagagctttcagtgagccgagatcgcgccactgcactccagcctgggccacagagcgagactccatctcaaaaaaaaaaaaaaaaagacataatgatataacctcattttcttctatgttttcctgctttcctaccaatatctgtaaaacattaacgtcattatttaaaaaaatatgtaacctagataatatagtaatcagacatcattgttaaatttacagcttaaggaagtaagttgtcttttcaatcagattagtcattctgtttttttagtaatagttatatattaatgaagtgaaactttataggtaggtatacatcaatgaaatcttaggcttttaccatctatattgcatacttctgacattatatcttattttccttaggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatctattaggaaaataaaaaatattttagagccaagttaacaagtacttcagcaaaacatgctcgttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttctttattgcgactattccttttttcccccagaattagtgctttggtttaggtctttgtctagcttaactacttccaattgattcttcagccttttcttttaggtttacttactataaaagtctcagaagaaagcataaggggaaagcttcgtgacattgtatttggcaatgatttcttgaatatgacaacagaagcacaggcaacaaaagaaaaaatagataaattgaatttcatcaaaatttcaaatttttgtgcattaaaagatgcagtgaaaaggcaacacagagaatgggagaaaatatttgcaaatcatatatctgataactgtctagtgtccagaatatataaagcactcctacaactcaaccaccaaaaaacaacccaataaaaattagcaaaggggctgggcatggtggctcatgcctgtaatcctagcactttgggaggctgaggcagtcagatcacctgaggccaggagttcaagaccagccgagccaagatggcgaaaccccatctctactaagaatacaaaaaattggcctggcgcagtggctcacgcctgtaatcccagcactttgggaggccgaggtgggtgggtcacctgaggttaggagttcaagatcagcctggccaagatggtgaaacccccgtctctactaaaaatacaaaaaattagttgggcatggtggcgggcacctgtactcccagctactcgggaggctgaggcagagaattgcttgaacctgggaggcggaggttgtagtgagcc

SEQ ID NO: 9530 - DNA, 467 bp, Homo sapiens
gccaataagcacatcaaaagatgctcagcataactactcattaaggaaatgcaaattaataccacttcacatccattaggatggcagttatcaaaaaagcaaattataaatgtcaaagatgtggagaaattggaacccctatgcattgtttgtgggaatgtaaaatgttgaaaacagtgtggcagatcctcaaaatattaaacatagagttaccatatggcctagcaattctgcttctaggtagattcccaaaagaaagcagaaactagaataggtatttgtacaacagtgttcacagctgcattattcacaatagccaaaaggtggatgtaacacagtgtccatcgatggatgaatagataaacaaaatctggtatatacatgtgaagaaatactattcagccttaaggaatgaaatttgatgctacaatgtagatgaacctttagaatattatactaagtgaaat

SEQ ID NO: 9531 - DNA, 467 bp, Homo sapiens; identical to SEQ ID NO: 9530

SEQ ID NO: 9532 - DNA, 602 bp, Homo sapiens
ctcttttatccaaccattttatttcactatacaatgttaggtatcctcagggcttgatttagatccccttcttctcccagacctttatccaccacattctcctatttaacaaaactgacagcccttcttccttagtgtctcttaaacttttcagtcccattgcttcaaggtgccatcatttcttagctagattattacaataacctccctttttctgttcttatgtctgcttatgcatactgcttcccccatcccccacactgtgtatagaatgatctctctgaaaggcaccctgcataaaatccttccccatcactttcaggctaaaatacagaaacctttctgttcatattagtgggtcagtctcctgctcctgaattcccttagcattttgtttctcgctctataaagacctataatgtaataacatctttatagtatttgagaacttattttctcctctaaatttataagcaatgttaaggtaagcccttcatctttgcttatcctctaataccaaacaaacttccataaaaatagaaggatctcaaaaactaaattgaaaaagcagtctagttgaaaaatagaggtgctaaagtaag

SEQ ID NO: 9533 - DNA, 299 bp, Homo sapiens
gcaagaagctagagagtgacttaggatacagtgtaaagatagtaaattaaggcagttctgcaagatttttaggacttctttttttcttctattcatcatttatgaagtattcttgctggaaatagtttatgtctctctatcttgctgactgatgaatactcggccaggatgctaaaatgtggtttcatgaagtatgttgtgtttctgtctgttcttgtttccttccttgaaatgtgtaaaagtgaaaaacatattaatcataaatcaagcattcatcataagcctaaaaaaagataaaa

SEQ ID NO: 9534 - DNA, 299 bp, Homo sapiens; identical to SEQ ID NO: 9533

SEQ ID NO: 9535 - DNA, 303 bp, Homo sapiens
gcaagaagctagagagtgacttaggatacagtgtaaatatattagtaaattaagacagttctgcaagatttttaggacttctatttttcttctattcatcatttatgaagtattcttgctagaaatagtttatgtctctctatcttgctgagtgatgaatactcggccaggatgctaaaatgtggtttcatgaagtatgttgtgtttctgtctgttcttgttttccttccttgaaatgtgtaaaagtgaaaaacatactaatcataaatcaggtattcatcataagcctaaaaaaagataaaa

SEQ ID NO: 9536 - DNA, 451 bp, Homo sapiens
acatgaaggtctgcgtattctttcacatgtgaacgtatgtggcacttttccatgatgcaacagcagcgggtctctagctaagctacagcagcagctctaagaggcagaggaccctgaaatgaggctgaaagaaagaatagtccataactgacatcaggcaggctgctgttgtaagcaaagaaaggaggctcacaggggcgcggactcaggccaggtcaggctattgtgggagaacacggagcacacgtgtcagctggaaaggggccggctcaggagacaaaataggcacgagaggaaaccgaaaaattgacatacgtgactatccttgtagaaatgtataaaggtttggattattttgcttatcgagttataataaacttattctaaaaatgtttatgtaaagtattatgtacatttttgttttaccttataaagattatttatatttgaa

SEQ ID NO: 9537 - DNA, 451 bp, Homo sapiens; identical to SEQ ID NO: 9536

SEQ ID NO: 9538 - DNA, 448 bp, Homo sapiens
acatgaaggtctgcgtattctttcacatgtgcacatatgtggcacttttccatgatgcaacagcagcgggtctctagctaagctacagcagcagctctaagaggcaggggaccctgaaacgaggctgaaaaaaagaatagtccataactgacatcaggcaggctgctgttgtaagcaaagaaaggaggctcacaggggcgtggactcaggccagatcaggctattgtgggagaacacggagcacatgtgtcagctggaaaggggccggctcaggagacaaaataggcacgagaggaaacccaaaaattgacatacatgactatccttgtagaaatgtataaaggtttggattattttgcttatcgagttataataaagttattctaaaaatgtttatgtaaagtattatgtacatttttgttaccttataaagattatttatatttga

SEQ ID NO: 9539 - DNA, 550 bp, Homo sapiens
cagggctggatcattccttgttcataattctttatattatttagtgtgtgtgtgtgtgtgtggggttgcatttaggatagtcagtagcatcctggcctctagcctacagagaccagtagcatctcccatcatgacaaccacaaatgtccccagacattgccaaatgtcctctggggacacagttgcctccagttgagaagcactagtttaaatttagaaaacaaattgggaaggatatataacaaattcgtaacagtaccctttgggatatgggattggaggaatggctttcactcctcttttaacataaaatttttaaaactggattttgcctccccctacagacattttttttttattttcaactgtggttttttttcccattttataaaaagattaaccttgaaaggtaatatcacatttcaattttagtcattatggattttactgtggaaggcagttctatacacctatggctgcttttcaacctagttttattggattttgtttgacattgtgaatgtcctttttcccaaagatgtgatagaca

SEQ ID NO: 9540 - DNA, 550 bp, Homo sapiens; identical to SEQ ID NO: 9539

SEQ ID NO: 9541 - DNA, 413 bp, Homo sapiens
cctggctcccatagtacatgttttatgaaggaaactaccagaaatccatgattagagatggaaaatatcagaccaattggaaattttcctttgactctcacctggtctgagcatcttctgtctttttggtacagtgaactactccagattgaaaacatttctgttttctccttgcctggcaagtgagctcagtgaaacatcctattagccacactgcagggttggacattgccacaccaggtcaagggaaagtggcactatgaaggcctgggcagcactgctgctttgagaattacgaggagaaaatctgtgctttaccaaaaagtaaattaaagatcctgcctggtatcagccttgcttgagtgactagtaaaattgcagaatagcttcataggaaaaaacaaaccccagag

SEQ ID NO: 9542 - DNA, 413 bp, Homo sapiens; identical to SEQ ID NO: 9541

SEQ ID NO: 9543 - DNA, 459 bp, Homo sapiens
ctctagcaagtcacagcagtttagggttgacatagcagagttcaaatgtctgacttttctcactgttgtgtacttgttggccaggatgcctcatttgactttgtctcacccatagtcattttcagatccaatggcccagtggcattctggcagctcttttctattcttcattcttggttggaacctgaaggtagtatgctcctctggctttggtctaatatttgaggccactctgccttcctagtatttgtataatatggccccttaagcccctaccgagatggctaggaagtgggagtgaaagttaaggctcttgggatggtgggaggaaagacaattgatttatttttgagcacgtatccaaaataaataaataatatatttataaacataaatgtatatgtctatgtgtgtatgtatgcatttatgtatgtattatatataaaatgatttatataa

SEQ ID NO: 9544 - DNA, 459 bp, Homo sapiens; identical to SEQ ID NO: 9543

SEQ ID NO: 9545 - DNA, 1591 bp, Homo sapiens
agggaggcaaaatgtgtgtatccctgagctggaagttcaaccaggcagatttcatgggcttctttcacacaagaagggtaagcatatttgacatatttgtcagggactggatggtggaaagtgatatttggcagttccttgagttctagaagtacctaaaatgatggtgaaaagaatttatagacagactgcaaaggtggaaaaatagcaaaatctggaagccgatacaagcttgatgctacattttgtctttgtgttacagggcaataaagtgacctaattttgttacaaatgaaaatgtgtattctttgaatacccagttagtataacacctctgaaatagtcatatatacacactccccaagtaaataaatcagactagtaccttccttagtacaagacattaagtttaatggaaaacagaaacaaactttcaccctattttggacatctgccttttctcaaggagatagggcaatttggtatatggagaaagggaaaggaggttgagtgcagggaagcaaggaaatgggggaagagctacacgtttccttctaattacactgtcatgattttgttcacgtagacatgccctttgagggaataaatagagataactaaacctcatctcaggtctgtttcactatcactagtcatattaccaaatgaccgcctggtttaactaaaaactaccagccttctaatgctaaagatgaagtgtccttttgactttttgaggggttgttataaagttatattagcctatgactaatttaagtacaagtaggaaaggagtaagacacaatttccaggtgttgctaagatgttatcttacgtaagtgattcagattaagtttgaggcatgttaaatgtcttccccctagcattttggccttggcaaaattacgtatgcttgtacaagccctgttttcttatttacagcaataccagaagaaatggatgtgactgctttacattaatttctactgatcccatccaaacagataatatcagaagaaatggatgtgactgctttacattaatttctactgatcccatccaaacagatgaacaacttgatgtcttcctttaaaaaaaaaatgacatgtggccttcatagcttttttccttccccttgatgtaaatctcaagtgtttaaaaggaggaatgagtctaaatcatagaaaatctctatttagattgggataagctaattagctattatttattgatcccttgctgtaagtcagaaactatattcgatgctttcaatgtattaaatctgatccttctctcaaccctgcaaagtggatactgtcctaatttttcagttaaggaaactgagactcaaagaggttaagtagcttgccaaagtctcacagctggaaagtagatgagctagaatttgtcctcagatcagccttgctttttccactctaccccactacttcccaatacccagagacaactgagttatgatggggtatggaaagctcccgaaggccagcccctctgggagactccctaatgagtccaccactatccattggaaaataccccagtttctgagaagcaaaaactctaccatgtt

SEQ ID NO: 9546 - DNA, 1591 bp, Homo sapiens; identical to SEQ ID NO: 9545

SEQ ID NO: 9547 - DNA, 6540 bp, Homo sapiens
tgcaaggggaagctgggtctccctatcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcagagtacagaaacggagtatgatgactggacttctctgttctctttcaggtttattaatgccagaagaagaatagtacagcccatgattgaccagtcaaatcgagcaggcaagttccaagtagtatctatatttatgtcccacaggcacaaatcctcatcaagttatactccagtagtttcctcatctgataaataagtgcttccaccaggcattctggatttttttttttaatgtccccagaatcccactcaaggaagcaacttcagtaagtggtgctaattggagatttcccaccctgactctactgacactgctttttattttctttctgaattggtaattgggcacaggtattaatgccacaagcagcgtgtttgtgagctctggcattaccccttgcttgtctgcatccaatcattagcacactctcatttttctgttacccacagctccttggtgtatgctaggctttcctttctgtagcatctgctgttaaacttattgtatccattcatttgcttctggctattcataatatcctattaaagcctgacttgctgcattgccaccattattttttattaaagaatattacctttgtataaaatgcttcacatccatgctgctaaaatacatgtgagcttttctcagaattctctcaatttctctaaaacagtttttgtatggtactatcagaaccctcctggtatactccaagtcgttttattttgaaacagacatttcctcagtttactgagggtttgtggtctcctgcaataaggcttatagggaaaaacagttttccttggggtgatgactgctgccactaacaacggtgttaaacttgatggagattttacctgtggcctcgctttaaaggatttgtgaaaattagtcatcctttggcaaaatttccccaataacgccaaaatatgttcccactattggaggctagggagaagaacataaaacaatggaaatattatatttactaagtttatatttccttggtgtgaataaaaaggcaagcttttaattgagtctatttaaccttgtgaaattgtattcaggtttaaaatgtttgtgtaaaatatgaacattttgtattaagccaccagagatggcagcctcagagaatcccaaccaaatggtacattgcaatatttgtatatggggtacccctaacttctccagccttcgtccccctaatcaagagataagtaaaaaagcaagggctgcagaggacgaaccccctgggaaactggccagtgaagtctttcttccagaacatttttaaagctactcacacaccttcactcagtcatcaagacactcagacaaaccacacccccatttgtagagtgccaaccacattgttgctataacgtttcagtgctgcagcgggaacaattgctgattgtttggtatatcttttcttctttctcctctgtgtcctcgaatgaccacaatcaggttttcttcttgatccttcagtgagccaaggagcagcatatagtccagagggtcagcccatggggagctttgtgttggatggtcagcaacacatggggatccggcctgcaggtaggttggctcatcccgcctctgggcttccctgggaagtgccacctgctccaccagcctctccatccactctactatcccactgtcatggtgggtttaacatttgcctgctgcctgctctgcctgctttctttacattgggtgggggaaaaaattcctctttgaaaaagtaaagattttaccacagtaccattatactctgccccatacacatcctttttcttttttctttttaaaccaaggcaataagtgaaaaggaatctgagtttccttctattttttcaccatcaattattgctgattttccggcctcttcttggattttatctcctttctaggacctatgagtggaatgggcatgaatatgggcatggatgggcaatggcactacatgtaaccttcatcatgtaaagcaatcgcaaagcaagggggaagtaagtacagtcgggtgcgatctgtcttcactatcacttcagagactttattttattttttataatttgcccccattttatttttccttgcccataactgcatgcctttccaaactaaggacctgtttttaaatatatatcacccatctctgaagtcacagatgacactgatgtgcacttttgaaaaggccaactgacaagcctgcgtgtgttttaagcaggtgggactgccttttagcctatttactgtggccccaatgtgcacaaacacagacatcaggcagatattggacatttaagaataaaaataatgtcttgggggcaccagttgactgagagaaattaagcaggcttcaatgaagcgataaaaaaaaaaaggaaaagtagaactgtcctttgagtgacataaatctgtcagaatacgattgatgcccaaattatcttatatgcaaagatgaaatgctgcagttcattatgcctagtctagatatatgacagcagtgacaccattgattcttcactagggagtcggtgtgttttgattattttttacatgtgcctactgacttccgacatgagacagaaagacaggaaagtcagtcaataaatttaaagggaaagacatttaggagcaactgaatatgaaggaatggatttttcactgaggctgaatggctgcagttggattaagaaacccattagactttaaagcttcaagtgtttttgacatctgaaaaaaattcagagtctgccaacaagatatatcctttgctgaagacaccagagcataaaaaaattcatataacattgaaacttccttgtttaatgaggctgaatataacaacacgtaccttgattaaatcattctctatatgtaaatagaggccaacattttataggggagctcagggggtcaccacggcacaccattgatgaagccaatttccttccttccttcctttactaatgcagtcaaaaaatgtagaaagcaatgttccctaaaacagctatagagaaaacatttgctcagcttggatagttcttaatataggccatataatttctagcctatttaattacataacatattttatgcttcatgaccaattacattaatagcttaatacagaagaatattatcctctcttgatttgattatgcagccacacaatatggtatatttggtacttaattatcatcatccattgagcaggctgctgtggtagaataaacagagagctgggactatgcaggctgtgttattgtctttagatggttttgccacttctgttaataatggactgcggatctacttaacaaaatgactgcagcatataagcctttagattaccagcttacagtgtcaaaaacatctgttcagcttttcaactgtatgcactggaggttaaatagaggtgaataaagctgtccttttagatccggggatgtgcaacagtaaatataaccttaattcaataaacaggtaacttgtaagagaaatcagaatccttacaattgctgacttcccaccatttaactcataactttgaatgttgcatatctcaattgagaatttctacatttattacattttattcctaatatcaaggcattatttggggggattttcagagataaactaccgggcatgtcatatgacctcacattgacttcttacctttgacctttacaatctcttgggtgtactgctataggaatgcctctaattcaaaaagggggcttcattttaaatacacgtaaaagctcatttcttcaaaatgaatatgctgtaatgttttgtgtaataaatttttcatgaggaaatatagatatgataagatgtcaattttattttattctactatctacaatttttgtccaggtctacaaatgcaacacagaaaaataaatgatctatcaacagttaactgataaaactcgactcaaaatttatattcttattgcatttatcaaagaaatgtactgaataccattttgaaaaacagttccactttatgacatttagttgcattaaatatttagttctgttgtgttgcattatactgctgtgcgatgaaattaaatgcaaactacaatttgaatgtctgcaaacattggcaagaatctgcagctaaatttaggtataagatttgcagtgtctgttgttttttttttttttttcttttcatctttgatgggtaaagtataaaaatgtttaggaatttgacccgctttctttttccctctctattttcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaa

SEQ ID NO: 9548 - DNA, 271 bp, Homo sapiens
cattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctccaaaacaa

SEQ ID NO: 9549 - DNA, 442 bp, Homo sapiens
tgaacatccagtccatgccatggtaactagttgaaaatgttatactggagtggcatttccaagttcagtgcttctataaagacctgctagctcacagaatgcttttttaatgttctgcattgttgtgtgtcccccattgaacaaccttttgagcggacctcgtttttactaatgtaaacattctgactagtatccaaagaaatgacctttgagtgaacctctaaccttccccgtaagtatttgtttgaagacagtgtggagttctcctgctgagaactaagaaccatgatgccttgcagctctgtgagtaagggagtgtttgggggaactggagagaaagacataaataagggaacaacctccagatgtaaagaataaaagagtgaaattaaaaagggaaaaaaatagcaattcgttttacccgaagagttagcctataccg

SEQ ID NO: 9550 - DNA, 2846 bp, Homo sapiens
agcagtgagtgcctgtggtcccagctacttgggcctgaggctggaggattgcttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgtgcacgcgcgcgtgtgcgtgttgacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcttttttaaacaaat

SEQ ID NO: 9551 - DNA, 857 bp, Homo sapiens
aattccaccaaggccagaagggaaaaaggaagaacccaccgtgtctggctgtgcgggccctggggagggtcgtgagtgcagcccctctctacttccgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggatgtgtgagccttgaagtgtgtgtgtgtgtcccagcgactgtccactgtccaggagatgcatgtctttgtattggagatatttctgttactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaat

SEQ ID NO: 9552 - DNA, 2846 bp, Homo sapiens; identical to SEQ ID NO: 9550

SEQ ID NO: 9553 - DNA, 857 bp, Homo sapiens; identical to SEQ ID NO: 9551

SEQ ID NO: 9554 - DNA, 1536 bp, Homo sapiens
gtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtgtaagtgtagacgcggcccaggctgggagacaggggcgggggtgaatggcgaggagactggcggatgggaggggtggcggcgggagaactcggctagccggttctgacctaggtccccgccttgccctcgcagggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcggtgagtacagtcccgtcctgtccccgccccagtgtcgttcccgcctcggcccgcggccagccaggctgaccctgctctctctccgcagaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaact

SEQ ID NO: 9555 - DNA, 210 bp, Homo sapiens
gcagagggagggcatgctgcccagtgctagggtagaacttgagcctggctcctacttttctccttttaggaagattttaaacttgcaaaacaggagcatacttgagataagacagtgcagcagctgaagtcttgccttccaaggcgataacagtgacctgtgcctcccctccccctcctcggccctcctccccctccctcctacagctgc

SEQ ID NO: 9556 - DNA, 549 bp, Homo sapiens
gaaaagaaaagaaaagtttaatagttttaaaagagtaatacctatattccaatcacttaaaattaacatattttatccaatcaaggcatatcatcattttatacatcaagaaagaaaagaaactagcgaacaaacggggcataatgccgcctggctccgcttccccctcccctctccccccgtccttaggagacacctctggagttcagaaatgctaggagagcaagctcttcattcttagaatccaggaagggccgggcttttgcagctctcctctgccaggaagccgctggggggcgcaagacgccagcttctcaccttggcagaagtgcctgcctgcaagcgcagaatggaaacttccccataacaaattcagaagtaccttgtacattcaccacccacctgaagaaagcctgaatgaaaggaacaaagccacggcgttgtttactttcccattatcgccccagtcttgcggcagggcccgggtttccatccaatccacccggcccgccactgtcctggccagtctccaaggcttcacccaaaaaa

SEQ ID NO: 9557 - DNA, 3610 bp, Homo sapiens
gcgccgggagaggcggcagcgcagccggacgcacagcgcagcgggccggcaccagctcggccgggcccggactcggactcggcggccggcgcggcgcggcccggcccgagcgagggtggggggcggcgggcggcgcggggcggcggcgagcgggggccatgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaa

SEQ ID NO: 9558 - DNA, 107 bp, Homo sapiens
tgttctttctttttgtctgctttcccccgtttgcgcctggaagctgcgccgcgagttcctgcaaggcggtctgccgcggccgggcccggccttctcccctcgcagcg

SEQ ID NO: 9559 - DNA, 2503 bp, Homo sapiens
gtcactaagcctcccagctcggtagacatggaagaaaaggtgtccttcctgcattatagaaaaagcacagatatgccagatgtgtgcttcaggcctggttcttgatgtgttaattgacgctaacaggttttagatgattcgtttcatttctaacagaaccagttgttcaaaactattgtcttgtttccagtgccaaagctgtggatattcaatgatgtttatcactctccccctgccgctgcagtcctaccctgcactgctaatcctccctcagcaaacagatgcccctggaacaatgtaggggtgagcacaaagaaattcaggagaagaaagtacactcatgtaattcaaaattgttatctctatcataagattagtaaaaagcctttgttcagattttttattgtgagcagtgttgtattttttgttattgtttcaagggataggttgatattttgatatcacttagaaccgagtcggtaaactacatatttatctttgattaactaagattctgtttttaaagaaaagaggacatctttggctagtaatgattaggtaacagtgaatggcaggtgccatatggatccttggagcacagacggacatcaaccagcaagtatttctcagattctaccctaaaatagtgacagtatgtcaggtgtggactaatatatgtaatagctttcaaaaggaactgaacaactagcaagtaaagagtaatttatattaaaagatcccaataatagatggactatggcaagaacctctgaactagtctctctgcttctactctacctctttacagtgtattatctacactgcaatcaaaatcttccttccaaatgtaagtaactgttcaatggcttcccatgggactcggaataaaagctcacactctttacaatggccctgcaggttcctcatctcctacctccagcatcttcactgtccctctgctccaaccacactgcctctttcttattcctccagacctcccaacacagccctgcccccaagacccttccaatgactctgatcctcttccctgcgctacccagtgtctcactccatcgattcctccacatcctgccaaatgtcacctaaccagaaaggctttgttgaaccaccccagataaaataaagtcccctgcctttacccatcactctctcttgcccggtttaattctttctagcacttacattgtgataatttcttttctgcctcctgcctcttttcattggaaaatatattacatgagaggaggtttgctttattcattgctgaatgttcagcacctagaataatacctggcacaaaataggtcctcaattattatacccaattcctcccagttctcttggaagtttctccattttaccattgaaaattccacatccttgtgattcactttgtcccagtgaattccaaacagttggccatcctacccttaatagatagttgttgaatgaaggaaaggaatgaagaaaaaagaatgaggacagggaaggagggaggaatctaggacagaaaagaagggagagaggaaaaaaaggatgttaatattttcttgttctatatgtagaaagcaaaagagtatttttgtaatcttttttcagcaaatgcctggatcaaattcaatatgattttaaagccatgagaccctctcattcttggttttgatgttgcacggtatcataatacatctgattggaatttcaatatcaggtttaatatactatgcaagctggtataggctctgaaattatgcatattcatgagagcaatcacacccttacttttgatataactggcaaagtaaggtaccacaagagaacaataatcaaagaaaaagggaggactaccagttgttatttacttatgacattttactggaaaaactcaagcaacatgaaagactatttctaaatgaagtactaaaactaacaagacaatgttataaagtgtcatattttctttccttttatacaataaaacattgaaaagctccaccactatgcagccacttcaccagatgcaataatatccaaatgtgaaagtaattaataatattgtagttttaattcccttggtatttcagagatatcctttgaacagcctaaatcaaatcatactggtacttatgagaaatagatatctcttgtgagtccttatattgtgcttcccaagaacctacagtgcatttcagttatttaccttgaaaattcttcagcccatccagagtgggtttggaaatttgtaatcattttgtagaatgtgataagggaggacctgtcttcctaaattctcaagcttggaattttcaagtcagtgtcaggaccataggctctctaatgcatatatatttgccctgagcaaataattatttatctctgtgcttcggtagttgcatctgtatgttaaaaataagattattgctatgttgatttcttatgacatgagagaagaggctttaaaaattaaagaaaagaagaaaacact

SEQ ID NO: 9560 - DNA, 2504 bp, Homo sapiens
gtcactaagcctcccagctcggtagacatggaagaaaaggtgtccttcctgcattatagaaaaagcacagatatgccagatgtgtgcttcaggcctggttcttgatgtgttaattgaggctaacaggttttagatgattcgtttcatttctaacagaaccagttgttcaaaactattgtcttgtttccagtgccaaagctgtggatattcaatgatgtttatcactctccccctgccgctgcagtcctaccctgcactgctaatcctccctcagcaaacagatgcccctggaacaatgtaggggtgagcacaaagaaattcaggagaagaaagtacattcatgtaattcaaaattgttatctctatcataagattagtaaaaagcctttgttcagattttttattgtgagcagtgttgtattttttgttattgtttcaagggataggttgatattttgatatcacttagaaccgagtcggtaaactacatatttatctttgatcaactaagattctgtttttaaagaaaagaggacatctttggctagtaatgattaggtaacagtgaatggcaggtgccatatggatccttggagcacagacggacatcaaccagcaagtatttctcagattctaccctaaaatagtgacagtatgtcaggtgtggactaatatatgtaatagctttcaaaaggaactgaacaactagcaagtaaagagtaatttatattaaaagatcccaataatagatggactatggcaagaacctctgaactagtctctctgcttcttctctacctctttacagtgtattatctacactgcaatcaaaatcttccttccaaatgtaagtaactgttcaatggcttcccatgggactcggaataaaagctcacactctttacaatggccctgcaggttcctcatctcctacctccagcatcttcactgtccctctgctccaaccacactgcctctttcttattcctccagacctcccaacacagccctgcccccaagacccttccaatgactctgatcctcttccctgcgctacccagtgtctcactccatcgattcctccacatcctgccaaatgtcacctaaccagaaaggctttgttgaaccaccccagataaaataaagtcccctgcctttacccatcactctctcttgcccggtttaattctttctagcacttacattgtgataatttcttttctgcctcctgcctcttttcattggaaaatatattacatgagaggaggtttgctttattcattgctgaatgttcagcacctagaataatacctggcacaaaataggtcctcaattattataccccaattccttccaattctcttggaagtttctccattttaccattgaaaattccacatccttgtgattcactttgtcccagtgaatttcaaacagttggccatcctacccttaatagatagttgttgaatgaaggaaaggaatgaagaaaaaagaatgaggacagggaaggagggaggaatctaggacagaaaagaagggagagaggaaaaaaaggatgttaatattttcttgttctatatgtagaaagcaaaagagtatttttgtaatcttttttcagcaaatgcctggatcaaattcaatatgattttaaagccatgagaccctctcattcttggttttgatgttgcacggtatcataatacatctgattggaatttcaatatcaggtttaatatactatgcaagctggtataggctctgaaattatgcatattcatgagagcaatcacacccttacttttgatataactggcaaagtaaggtaccacaagagaacaataatcaaagaaaaagggaggactaccagttgttatttacttatgacattttactggaaaaacttaagcaacatgaaagactatttctaaatgaagtactaaaactaacaagacaatgttataaagtgtcatattttctttccttttatacaataaaacattgaaaagctccaccactatgcagccacttcaccagatgcaataatatccaaatgtgaaagtaattaataatattgtagttttaattcccttggtatttcagagatatcctttgaacagcctaaatcaaatcatactggtacttatgagaaatagatatctcttgtgagtccttatattgtgcttcccaagaacctacagtgcatttcagttatttaccttgaaaattcttcagcccatccagagtgggtttggaaatttgtaatcattttgtagaatgtgataagggaggacctgtcttcctaaattctcaagcttggaattttcaagtcagtgtcaggaccataggctctctaatgcatatatatttgccctgagcaaataattatttatctctgtgcttcggtagttgcatctgtatgttaaaaataagattattgctatgttgatttcttatgacatgagagaagaggctttaaaaattaaagaaaagaagaaaacact

SEQ ID NO: 9561 - DNA, 299 bp, Homo sapiens
aatgcagcatttttttttttttttttttttttttttggagaaggagtctagctctgttgcccaggctggagtgcagtggctctatctcggctcactgcaagctccgcctcccgggttcacgccattctcctgcctcagcctcccaagtagctgggactataggcgcccaccaccacgcctggctaattttttgtatttttagtagagacggggtttcaccgttagccaggatggtctcgatctcctgacctcaagatccgcctgcttcggcctcccaaagtgctgggattacaggcgtg

SEQ ID NO: 9562 - DNA, 284 bp, Homo sapiens
gcagcattttttttttttttttgagatggagtctagctctgttgcccaggctggagtgcagtggctctatctcggctcactgcaagctccgcctcccgggttcacgccattctcctgcctcagcctcccaagtagctgggactataggcgcccaccaccacgcctggctaattttttgtatttttagtagagacggggtttcaccgttagccaggatggtctcgatctcctgacctcaagatccgcctgcttcggcctcccaaagtgctgggattacaggcgtg

SEQ ID NO: 9563 - DNA, 13460 bp, Homo sapiens
gcccggccgcccgccctcgggcctccccccgggccctcggtcccctcccccgctggcggggcccggacagaagatggtgcagaagaaaccagccgaacttcagggtttccaccgttcgttcaaggtgaggcccggggtcggtttgggggcgctccgggctggaccaccggaatggccggcgtggggggcgcggggcccgcccctaagatcggctcccggggctcgtgcctggcccccgccctacacccggggctgcccgggccggccgtgcgctgaagcggggtcggtgtgcgaggatgggggttcagcaggccacagtcctctctccagccatggccgccgggtccttcctccaggacccccaagtgaggctgggagcaggagccccctccgggtcagggcaccaggctgtgtgtcccctgcaagcccccgccgggtatgttctggggggtcagcaggctgcagtcctgtcccagtcgctgcatgtggcttatggggggtgtcccctgcaagctccagctggttgtgccctggtggggacgggtcagcgggccacagtcccattcccacctccatgtggcttctggggactttctttcagaatccccaggccgggctggtcaggtgcacccacccccagggggcctgtgccgtgggggaggggatgggatgtcccctcagccctgcacttcgcagacaccccaggcccaagtgctgtttcctgtcggagcgggaagtttctgcgcagcccgggtggtgactgctgttgagtgctggtttcagatgagcaaatcttgggggggaaggggagggcaggtgctgggcaggggccccgcaggacctggcccaggggacgcagtgatgtcagccggcccgccccacccctcaggccggggttatgtaatcgcttcactgggcttccttgggcagggacctgttgcccggtagggaaggcaggactggagagaggaagagagagtgtgagtgtatgtgtgtgtgtttgtgtgtgtgtgtgtctctgtcttgtgtgtacacacaacgcggtgctccagggtgggaggagcaaagagagactgggaagaattcccaggtctgtccagccagtgccccagggcagcactccacccctgccacccctgcccagttttcccctagggcagcaggcctggcaccatcagagtgtcaggggctgggcgggaaagaggaggacctgacagtggtcttctccctcctagggccaggcatgagctgatacagagtcagtgcatggggccagccaggcagctaaagcacacttgaactttctagatggttccagccacctcctgccaaggcctgctgactcgagtcccacagccagacctagaacagtgggaccaggaccgcccacactgcccaggattgtgggccggcctctgtgcatggccagggcagcctggctgggagctgggaaggtgggcgtcttggtggaggagggcctggcaggcagtcctggctgtgaggtgttcctccaggtggccgggaccggttgctctaggaatctccccccacagcccccaccatgcacggctgctccctggattggggccacctctcctgaaatactctccttgcctccagcaggcagcagcccagcagggaggcacgtctgtgggtgccttgggtttctttccgttcgcagatgggaaagtgaggctctgagactgcaggcgcgtgtgcctggggctcccctgtacacgggcgaggaggccgcggagtctcgtggtgcctggcccctccgctgtggtggctgcggccgtccatctgtagctttgctgagttggaggctgtggctggcacaggggaacggtggccagacagggccaggagctcacgctgggctctgtggccccttaggtcatttcactctcgtgagctcccacgagttgggggcagctgcctcccgtctcaccgctgacagaccccagggtgaggtcactaggccaaggtcagacagcaggtgaactccagtctggccttagaccctggtcacctgccttgtggtggctgccccagggccaccaggggcctctggacaggagccttatgggaatgctgactcccatgggggctagttggagccccccccttccttccctcctcccccagcagcctcctggtagctatctgcccgagccagggtgggtggggaggcaggagggcagcttggctcacggcccctcccagactctgccctctggcctccacccatctcctggccttgggtctcccacgggctccactggagtctcacttctgctgaacgaccctcttgttagagccccactcaggttgtctggggcccagagaggggcagtgacttggcccagagcagccagcatcctcactgggactgggacccccgccacctctgtgggcccctcccgcctgggttcacccagacgggtgaagctgagtgagagctcagtggtacaaggaacctgaccgggcctcggttccccagcttcaaaggcccggcccctcgtaaagggccggcagtccctgcgctgggccatttgctctgtggaaacgtacatatgtatgccaccatcttccacgggggctgggcaaagcctactctaatctgcactgttccttgcaccctggtcagggtcttgctcccatggtcctggggctgggtcaagaaatgacccagccccagcctgcccagtgcaacaggcctggatttgaatcctggcccccagggcccaaggcggcttccttagccgggtatcagggcccaccaggggctccctccaggggtgtctggcactgaaatgggagagtgcaggatgtggtctgggcagggcctggcacactcgcgcctgtgggtgcctctcccgtgagcccccaggaccagtacagcactgtgtatactgactcggtaactggtagctgcggggttggggggctggaagcagatgagcctctggtgggtggcgggggcgtaggtgcacagagctggcaggggaaaggtgtgccgggcagctgcgggacatgggcggaggaatgcaggtgtctgggcttgggtaggggcagaaggcaggggtgatggaagcagagcccccaccttcagcaggccccagagcaccaggcactgaattcttaccccgccagccccaggcactgagcgaaagggaggggagcagcttaggggaaggagaggtggttgtgtgccatcttagatgggggaaactgaggcccagggaggactcagctgccctgagatggcccaggaggccgtgggaaagcaggcacagccaccaggctggcagcccgcctagtgactcacctccttcccactgccccgctgcctttgatccccgcgacccgccccagaggtcagccgtccccattctgtggacaagcagacggaggtgcaagacacggcttgggccccacggtgactcaatcctggcatcagaggcagggttcccaagagccagctgcttgtgtctgtcccctccccgcaatgcacccctttcccagaggcccccagggctctgcaggtgggaggaggtcttccccacggccctgtggaggttggggcccatctttctctggggtggggctgtcctgggcactgcagggtgctgagcagcacccctgccccaccccactccgtgccaggagctcccccaaccggtcacaaccacagatgtccccagacatggcccagtgtctcctgggggacagaatcaccccctgggttggcaaattccatggaccccctaagagactctgcgtcccctgatcttgccttgctgaggtgctaggaggcctcacgccttccacatgtggcccacacctgtgatcccagcactttgggaggccaaggcaggaggatcgcttgaggccaggggtttaagaccagcctgggcaacgtagcaagactttatctctacaaaacataaatttaaaaaagagagaaatccacacacacactgagtgtggggcagcgaggaggtgaatcccaggagcttgggggtcccctggtttatgctgtctgccccttcgggagttgatcctggtgggagttgatcctggtgtgtgagcggggacggagttgatttttccgtaatgctcagcgcagggcttgtcagtgtggacgctgcgacactggggcaggataggtctccctgctgcgtgggcagggatggggcctgagtgcctctcctctcctctcccctgcaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaaggtgagcggggatggcgggcattgggggagccgggagcggggaaaagccagggtccctctcacgcccgccccgctgcccggcagacgtctaccagctgcaggaagatgtgctgggggagggcgctcatgcccgagtgcagacctgcatcaacctgatcaccagccaggagtacgccgtcaaggtgggcccgcgccgcgccctggggaacccagcgccttgggatcggtgttgagcgggggtggaaacagtgtgtggcattccggctgtccgtcctacagccgggaagacccgtgtctaaaagtggccaccgggccctgagtccagtcgggaatgacagtgagggtggcccctctggtaccagggtgggggcttcagacagaggcactgtgcccattgggtcccctgggccgtccctgcctctgagctgtccctgagggtacatgacagtttggtttcaaggatcaaaatgcaatgtcatatcccagggcccagaggggctctgcgtttggggaacctcagtgcaggcccgtgagagccccctgtgtcactctagccctgggcggctgctggacccagggtgtggccgaagggctgggagcaggagccctgttgaggctctggttgtgaccctgtgaccttgtgggccggttggatcccgtgttccaagaaatcttccaggcttccctcgtgacctggcatccggctcccgggctgggtggggtcccaggagggctggctgcctgggaaagagggccaggtgtgccctggcgagcagggctcgccaggagcctgtgggtcctggtggacggccaggctagagctttcctctgaggagaaggaggaagaagaggggtggccaacctggggaggttactggctaggtgctgggaccacagtggcagcaggcagggacagacacagtacggacggtccctgcctcctgggagcccccaggcaggccaaggcaatggtgcaggagcactaggcccctccggaagcacttccacacagcaggcgttcctctgagcacagccctctcctggtggcccagccttgcttcctgtctttgtttgacagatagggacactgaggctcagggggttaggtagcctgactcatgctgtgtggcctctgggggatcctaactggtgtctcagagccacctccctggtcatcttgccacattgacctggtgtggtcagtgttgggatctgcagagcctgggggacttcctgctggaggtgttgttggccactgacgtccgggagttggtctggccaggtggcagtgggaggaggaggtgtcctgggcgagtcagagaggcgaatcgctgggcctgtgggtctgaggagcgttgtttcgttctatggggactggggtgtgggccctctgccctcggggtcatgctgcgggaagccaccctggggtcacctggtgccgtgaggctgctggctggatgcagagcccccatgctgggacctcagaataggccccttccatgccaggaggggctgcgccccctccctgaagcagcattctagccagccacccaagggacaggacgaggttcagttttgtccagaaccatctgcagtgcctgctgggcacagctttcagcagcggcctgggtggtggtatttcaggacaccctggcgtccagttgttctcttgcccctcgctgggacagtgttgtctgtcagtatagacatgggactgcagaggcaggagccagggactcaagggtggaatgccacatccctgctgccaccaggccatcgcactgggcagggaaccctgggcagagtgctcatgcagccaggcacccgcccagtgagaggggctaacatgtccagcctggcaggagggtcccagcaggtgccaggggaagctgcagacgcctcctcaccccacctctgtgagtgaaggtggcagggagcagctggagctgctgggggcagtagagtggcttcctgaggctctggggctcagggaggctggatccgccagtggctgggacagccaaccagggtgggcccgaaacagatattggctgaggcggcaggcaagtgtctgcccaggctggcacggagctggggagcaggacttggtgctgtggccacatgtgaggtggggcctggtgggctggcagccaggtgtcctgaggcctccctagttctatgggtgaccaggtacccaccctgtggggaaagaggactacagctgactgtctctgggtcagggagggtggccgcccagggcagggaaccctcacgtcctgtgggggtattttgcagaagtcataggtctcaaatgtgtctctgagggctgtcagggtcacaggtggagagcagcctccactggctttttttttttttttttttttttttttttgaggcgaagtctcactctgtcaccaggatgctggagtgcaatggcgcgatctcagctccctgcaacctccacctcccgggttcaagtgattctcctgcctcagcctcacaagtagttgggattacaggcgtgtaccaccacacccagctaatttttatattttcagtagagacagggttttgccatgttggccaggatggtctcaatctcctgacctcatgatccacccgccttggcctcccaaagtgctgggatgacaggcgtgagccctgctttctagagttgcagggcgttaagtgtggtgaattccagccgtggcagtggagtttctggccccttctcgactatgagcgtcccaccaacccaggtgctgtgtcctttcgcctgtttcagatcattgagaagcagccaggccacattcggagcagggttttcagggaggtggagatgctgtaccagtgccagggacacaggtaggtgagccacccttgccaccgcactggcctgagctgtctttcagtggatgaagggcctgagtgccacatcacccccagcaagcgtctgtagggcacccagtttcccaggccctgcattcccctccctgaagcaggctggctgacagccccaggcgggcagtgtgaagctggcctattgccccagtcccagcttccggtggacaggccagcaccaagagggtgggcccctcctaggccgggcagcaggtacccaggggcctcaggaagcctcagctcctctcctgcccccacccccaccccaggaacgtcctagagctgattgagttcttcgaggaggaggaccgcttctacctggtgtttgagaagatgcggggaggtacctgggggctccaggctgtgaggagggagggagctgggaggtattacgggatgggggcctagtgccacctgcaggagggggcttgtggggtgagtgtcctgcccaaatggtggctcaggggtgaggcctttgtgctggaggaagccagtgtgggggcgtccccgccaaagtggaggtgggtgctggccttgaggggactttgaggtgacctgcgtgttccccctgtcctgccctgccctgccctgcccaggctccatcctgagccacatccacaagcgccggcacttcaacgagctggaggccagcgtggtggtgcaggacgtggccagcgccttggactttctgcataacaaaggtaggtggtgaccccgcccggagtctcctagggccgcctgccaaggactcctggaagacctccagaccctcaccccgtcgtggttctgtggcttctcccccaggcatcgcccacagggacctaaagccggaaaacatcctctgtgagcaccccaaccaggtaggccagttccggcagggtggccccgcgggaggggtggaccgcgtgggaccccaggctcacggaccttttggcccctcccaggtctcccccgtgaagatctgtgacttcgacctgggcagcggcatcaaactcaacggggactgctcccctatctccaccccggagctgctcactccggtgagggcccgcggggagggctgggggctcggccgcctgctctgcggttgcataacctcgcggagcctgggccatccagcagctccaggccgcggagctcgggcttccgcctagcaacagccgctgattggttgggcggggtgtcgcggcggggcctcgagcaggcgccccaacgcgtcggtgtttggccgggtggggcggggccgcggcgggggaggggcgagctctgcacctgctgattgggcgggggcgcgttcccggcagccgctgattggtcgggcccggcggggcggggtccgagccggctggcgcaggtgacccgcagttacccgggctcggttcccacgtaatgctgggaaaccccggctgacgcgcccctcccccgcccgcagtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccaggtgcggcggcccgcgcaccctcctctcctgggcaccctcctcccccgggcctgccctgaacaccccctaaccccaggggacctgccctgcgcaccctctaagtccaggggacctgccccctgaccaccccctaaccctcggggacctgccctgtgtgctccccagacccccggggacctactctgtactccccctaacccctggggacctgcccggtgtgccctactccctgatgccatccacagggcagtgccgccctgtctgccagtttcccgaaggcttttcaggtttgcctgcccaagggaaaccccagacagggttcagagagctgagaggtggagtgaggcccctggtttggggggatcaggctcaggctccctgcccgcggcttaaggctcagcatctgtggcctgtggtccctggaaccaggtccctcagagctgcttttttgtaaatccagctccacttgggtggagctgactctcctggtccggctcccagccccctctgccccaggcgtgcgtggtctagggcctggtctagggcctggttggggtccggttggagccacgtgtcagtgcacagtatccaggcccttgggcaggtctaagctcccctgtgttctatgtccccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcagggggtgagtaccagccgcacgggcggcaggaggggtatgggggcgctgcagggtggcctcagagcgagcatgggaagccctgagggtgtagcctggacaccctgagatgcactgaggcttgagagcacaggctctgccctgggatgaggggtgcagccgaaatccccaccgcccgcctgtgcacggtgcccgctggccagccaggcggctcccaggagcagctactcagagaaccttcctggagggtggtggggacccacagcctgcagcaggctggagcgaagcgggcagcgagcccagctcacatagaccccagcctagcctgccgtcagtctcaagcccaggctgtgcctccacccttccctgtgtggcctccagtcgaggaggagtcgggtgtttctcctgccagaggtcatctgagctgagctgccaccccagggagtgaggatttactaaaaatagaagctggggtcactctgtgtccccaggcgaggggctgggggcctccaatctccttgcagaagcatccagagacccatgggttaagaggggggcggaggtgggtttgggctgggaacagccgggagagatggggcttggggctctgcccccaccctcactgggtcctgtaacaccaggcctcagcctggcccagcctcgggttccctgggcagggggacatggagcctcaccatagggacctcggggtgggcgcttggctcccggggcacccaggtgcactcctggtctccggtggggtcctggtgatgggatgggcatggcatcccttggccagacaccccacccagcgccccaggcggccccagctgctctccagccctgcccccgcccactctcgttgcagtgcgccccggagaacaccttgcccactcccatggtcctgcagaggtaaggcccgcaggggtgctcgggacccctgagtccagggggcggggtttccaggttaagacatttgtgaaagacccggagaactgctttggggtcggggaggcaggcaagcctggtgactcagtgaagctcccggtggggccctggtgctcagaggagccccagggtgggggctgggaggggggcatgaagccccttcccccagggccttcacagaccccaggggtcccctgaggggtgcctcttggtgaccacctacccccaccccgtttcccaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtg

SEQ ID NO: 9564 - DNA, 138 bp, Homo sapiens
tagtcccaggtacttgggaggctgaggcaggagaattgcttgaacctgggaggtggaggttgcagtgagccgagacgatgccactgcactccagcctgggtgacagagcaagactccatctcaaaaaaaaaaaaaaaa

SEQ ID NO: 9565 - DNA, 113 bp, Homo sapiens
ccgcgctggcggcggcggcggcgctgttccccgcgcggtccgcggagcggggtccgggctgcgcgacgtggggcggcggcggcactgcggccccggcccaagcccgaccccgg

SEQ ID NO: 9566 - DNA, 870 bp, Homo sapiens
aaaactttgtgtagcatgcctggttgtacgataagagctgagtgaaagatgcagtatcccttttccacacggaaaagccaaatagcatcagcaacaacaaatagaataatgcagtggtttctatcatgctaatttattttgctttggagcaggtacctttcctctatggcattattttcttgcatttctcataaaggggaggatgcatcccaactgaatggctcactggcatgtcttttatgtgttcagttgccattcctagctttggaaagtttctatctgtccatgtgtatacaagtcaatgccccatttttgtttttcttttaaccgaggtgtagataggaaaaggacatttttaattacttaataaccggaaatgcagatgtgtaaggagaatgagaggaatgagttaaagtggttatgcatttttctatagatgagccattacagcaaggaattttacagttgacttctctgaacctagctttaccacagtgattaaatcctatttagaaaggggaatctgatttaaatgtgtgattccttgtatttgctcctatcacaaaagatatattaaaggaggtatgccattaatgaaatccactgtcctgagtattatctttcctcctgttgtactttctcagagactatggcagaatatctggatcttccttggattttgtacacatattgtagtgaaatgtgtcctacatctgaaattgcatgggactcatgcccagcaatctggttctaggcctttgacacctgataatatgagagcaattggccagccaatagccataagcccagaggattttagagcttcatgtgtggcttttaagagcaggtttgaaaaaaaaaaaaaaagac

SEQ ID NO: 9567 - DNA, 868 bp, Homo sapiens
aaaactttgtgtagcatgcctggttgtacgataagagctgagtgaaagatgcagtatcccttttccacacggaaaagccaaatagcatcagcaacaacaaatagaataatgcagtggtttctatcatgctaatttattttgctttggagcaggtacctttcctctatggcattattttcttgcatttctcataaaggggaggatgcatcccaactgaatggctcactggcatgtcttttatgtgttcagttgccattcctagctttggaaagtttctatctgtccatgtgtatacaagtcaatgccccatttttgtttttcttttaaccgaggtgtagataggaaaaggacatttttaattacttaataaccggaaatgcagatgtgtaaggagaatgagaggaatgagttaaagtggttatgcatttttctatagatgagccattacagcaaggaattttacagttgacttctctgaacctagctttaccacagtgattaaatcctatttagaaaggggaatctgatttaaatgtgtgattccttgtatttgctcctatcacaaaagatatattaaaggaggtatgccattaatgaaatccactgtcctgagtattatctttcctcctgttgtactttctcagagactatggcagaatatctggatcttccttggattttgtacacatattgtagtgaaatgtgtcctacatctgaaattgcatgggactcatgcccagcaatctggttctaggcctttgacacctgataatatgagagcaattggccagccaatagccataagcccagaggattttagagcttcatgtgtggcttttaagagcaggtttgaaaaaaaaaaaaaaaa

SEQ ID NO: 9568 - DNA, 868 bp, Homo sapiens; identical to SEQ ID NO: 9567

SEQ ID NO: 9569 - DNA, 750 bp, Homo sapiens
cttcaaagcaaggaaataagatgctgtatatgcacacataaatgcattgataatgtaaatatcctattcacgctaatgaattactagatattaaaagtggggggtggaaatcattgtagccctttattgatgacacccattcattctggcttcagaccttgcagaggttggccatatctttttaaaagtgtcattgatgataaaagggactacccaaggctaaagcgtcaacatttttcagaacaattgcttttctcattatttacaacctatataattcaactttgaaataacccttattttgaaaaaaactgttctaggtatggcatgttttgttttttccctcaggtatattcaatacattcttcatatttgggggaactgcttttgaaaaagggatactgcatcttaacagttatcttcagtgtgcatccagtaaagtctgcgtgttgagtatttgagctacattccatatattttggccaccctcataccagaggacagccgtagttcaggaggctctgttttcaaaagcaagttcaaaagcacatgcacattgagggaagatgaaagaaaacaaaaaccaaccatgcccatttaacttcagattacagagcacaaaatgtggagtgccattaacccattgattgattgtggctgtagaatttaaaaagcaaacatggggggggtggggaatcatctgtatccagggtaagaatgaccaatattttcacatgggatcatcctaat

SEQ ID NO: 9570 - DNA, 750 bp, Homo sapiens; identical to SEQ ID NO: 9569

SEQ ID NO: 9571 - DNA, 750 bp, Homo sapiens; identical to SEQ ID NO: 9569

SEQ ID NO: 9572 - DNA, 3741 bp, Homo sapiens
atcatagcctcctaaggccaagctcctgcctttcagcagcctctacaggcccagctcctgcctcgcaattgcctttgtaggccaagatcatgccgcgaagtggcctttcctagcctaacttttgctttttgacgcatactccagtcccaaaacttcctccagtcagccggtccaggccaagctcttcctcccaaaggcttctgcaggccaaaatcatcctgaagtcaccctctgcaggcccagctcctgcctccaagtgctgtgtaggccaagctaatgcctcacagcacactttccaggctgagcgtttccttttgtgcatcctctccaagccctgaacttactccacttggcctctccagaccaagctctccctcccagtggcctctacaggccaaaattgtcctcaggtctgcctctccagggccacctcttagctaccagtggcttctgctggccaaaatcgacctcaagtcagcctcttcacacccagctcttgcctctgagtggcctctccaggagcaaaactttctcaagtcggcctctccaggcccagcctcctgcttcccgagggcatgtacaggcccagcctctgcctcacagcagactctccacacccagctcttccctgtctgcggcctctccagtccaaagctgctgctgccttttggcagcttgtacaggctcagctcctccctcacggtggcctctttcagcccaactcatgcctcttgcaacctgcccaagtgtcagctcctgtctcacactggcctgttgagggccagctcatgcctctcgtggcctcaacaggcccatcccctgcctgtcggcggcctctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctcatgcctcccggcggccttcccaggccccgcttttgactttcggtggcctctgcaggcctcgacaaggcccggcctcctgcctccagaaggcctgcacaggcccagcctctgcctcacagcggactctccacgcccagctagctctcgcctcactgcggcctcccgagtccaaagctcctgcctctcggccgcttcggcaggcccagctcccgcctgccagtggcctcttcaggcccatggggctcattcctcacaacagcctttccaggcccagtttttcccttccggcggcctctccgggcccagaacctcctcaagtcggcctctccagacccacttgcagcctcccggcatcctctccgggcccagctcttcctcccggctgcgtctccaggcccgactttggcctcccaacaacgtctttggactcagctcctgcccagctcccagcggccctggtaggcccacagcttcccgaagccaagctccccaggcccagctcaggcctcacggtggcctctccaggccagctcctgccctctgatggcatctgcaggccccaaacggcctccggttggtgggctcctctaggcccagcttgggcctcctggcggcctctgcaggcccaaatcgtcctgaagtcggcctctccaggcccagctccggcctcccggcggcctctgcaggcccaagtcatcctcaagtcagcctggaattgggcctggaagagagcaagtcggcctccccgggcccagctccggcctcttggcggcctctccgggtgcaaaagttcctcgagtcagcctctccaggcccagctcctcctgcctcccagtggcttctttcagcccagcccagctcatggctctcagcggccttcccaggtcccgcttttgacttttggcggcctcttcaggcccagaacttgacctccagtcggcctttgcaggcccggcctcctgcctctcaaaggcctgcacgggcccggcctcggcctcggcctcacagcggactctccacgcccagctagctctcgcctcactgtggcctccccagtccaaagctcctgcctttcggccacttcagcaggtccagctcctgcctgccagtggcctctttaggcccagctcattcctcacaacggccttcccaggccccgtttttcccttccggcagcctcttggcctctaatttgtttatcttttgtgtataaatcccaaaatatggaattttggaatatttccaccattatatattttggtaggtaatttatttggagtgagtttctgcaccatgccagaattttttattttattttccttattatttagtgttaaacaggtttaatgacggtcatggcaactttttggcacagtgaaaaatatcgcccatgatcaacgtgttctgttctggggaagggggcaaaggcagggtgaatcactttcttaaaaagtatagctcaagttgggagtgcagagggaatggggagaaaaccctcccgctgcctgtgtcgaagtgtaggagcccccacccccatactcacctgagtccagcccctctggggaaagaaggggtgcatgaactccccctagtccacaggcacctccctgtggcccaaggctctcttcacactccatcttgaagccccagcaggagctattttccaaaaagtgaaaagctctgaaggtcccacaattcatggtacatacaggggctcggaggagggaaactgcccagctttcccccggcacagctgcaggggtagggggtatagataagaggagcaggccttggccaggcgtggtggctcacgcctgtaatcccagcactttgggagggggaggcaggcggatcatgatgtcaggagatcgaaatcagcctggccaagatgatgaagccccatctgtactaaaaatacaaaaattagccagacgtggtagcgtgcacctgtaatcctagctacccggaaggctgaggcaggagaatggcgtgaacccggcgggaagaggttgcagtgagccaagatcgcaccactgcactccaacctgggcaacagagcaagactcggtctcaaaaaaaaaaaaaaaaaaaaaagcaggccttgttccgtcccaaactgaaaggattaaatggctttacctgggagaagataaccatcctgccctccattgctacccccacatactgtccatgttctcagggggtactgtgagtcctgggatcttctttggggtcgcccacctgcctgtggtagttatggagacccccaggtgttgaggcagggctggggtgtccccttccaaccaggctgtcaaggccccagctctggggcagaggcagtggcagggcagccagggttgcgccagagcctgagcagggtgaggtggggtcaggcagggctgggagtcagggcaggggcagcagcagtggacccgctatg

SEQ ID NO: 9573 - DNA, 321 bp, Homo sapiens
ggctgggagtcagggcaggggcagaacaaaccttggaggggaagatgtgtgcatagtgggcctggtgggcggctgtggcctagtggacaggaagaagcagtgggcctggaagagctgcatgatcagggccggcactggtccagggcgcgtgcagtgaagaggacagcaccttctcggtctccggttccctgagcctgtcctcggcttctccacctgtacaggcaaaggggaagctgtccccatcacacatggcacacttgggggtgttgggctttgggctgcagctggagcatcttctcatcttgcatttgggtgtggtgg

SEQ ID NO: 9574 - DNA, 251 bp, Homo sapiens
tccctcactgcggccacagaaagccaagtttctccgtgcctcatggcatcctccgaaaactgagcatttgcctcacggtggcctccccaggccacgaatctgcctgcctcccaggcaggtgctgcctcacaatggtctctttaggcccagctcatgctaaaagatggactctccaggtacagctcttgcctcctggcagcctctgcaggcccaaattctccaaaagttggcctctcctaactcagctcctg

SEQ ID NO: 9575 - DNA, 360 bp, Homo sapiens
caaggctgcagggtgttgtgattgtgcctgtgagtagcagggtgcactcccacctgggcaacagagtgagaccttgtctctaaaaattaaaaaaaaagttaaaaattaaggaaatattctttcagtattcaagaactattctccaagtcagcaaagaagctgctcacatcattgacagatgagttgaagttccaacatatatgtctttgttgtttcacttttgtcttatttgttaatgcaaacaaaaatatcaaccaatactctcatgggagctaacattcttttgtcgattgcaaccataaccataggttggctatggatatgagtttggcaaaagtcaataaaagcattctatgagaa

SEQ ID NO: 9576 - DNA, 346 bp, Homo sapiens
aaaaaaaaaaaaaaaaaaaaaaaaaaaaagccgggcgcggtggctcacgcctgtaatcccagcactttgggaggctgaggcgggcggatccaggggtcaggagatcgagaccatcctggctaacacggtgaagccccgtctctactaaaaatacaaaaaattagccgggcgtggtggcgggcgcctgtagtcccagctactcgggaggctgaggcaggagaatggcgtgaacccgggaggcggagcttgcagtgagctgagatcacgtcactgcactccagcctgggcgacagagcaagactccgtctcaaaaaaaacaaaaaaaaacaaaaattcaaaaaaaaaa

SEQ ID NO: 9577 - DNA, 891 bp, Homo sapiens
gatgaagtttacattaatgttagtaatgtccttggagctaagtcttcgaaaagtactctcaagtgtgtaccctttagggaaatataatcatgaatgagaaactaggtggtctggaagaggaatgatcaatgatgacacttattccaagttctcagcctcacagagcaataggagccagctcgcttaatttctctgtttccatatttgcaaaataaggattatctgtgattatctgtttccatttagtggttgctctgtgaaatatttgaaatcagtgtagtggtgagtggatgataatggtgagaagcgtttgggagctagggaaaatagaagtgtctgccccctctctgttttgctattcagtagctgtaactgtacagattcttcctcagattgaaactccacttcccttgtttcccggtggttagtcccactcctgctcatgcgacataagaacatatataataatccattttaatatatttactaaccaggtccttttgttgtgcaatattttgtatacttaattcagtccttcaacaaatgcttgcctactagaacactgtgttaagtgctgaggttgcaaatggtttcttgtttaactttcattcaacaaatactgtatttcatctgcatctactacataacatttcctgtggtgggtgctgagaatgcaaagttaagatagaaacttgaccttgagaaacatatgtccagtgagagatacaggaggaataaataatacttaaaccgcatttatgtttatcattacattatcatggctttttcctagtaaaagttatgtaaatgttatttgatgtttctgctgaacatatgagcatgataagctgccacatttccaaaataaagataaggaagttgtcattagta

SEQ ID NO: 9578 - DNA, 891 bp, Homo sapiens; identical to SEQ ID NO: 9577

SEQ ID NO: 9579 - DNA, 466 bp, Homo sapiens
ctgaaacatcccactagcttgaatggacatagtagccatcaccgtgttttacagacaccatgcttcacctgccaggcaggatcccttttaacttgtcccatgccctttgcagttaatgaggttgcatagaatggattctaggatgtgatacagactccagagacatgtggacattgggaacaatatcatgaatgtacttcagggacatcagctgacagttcactttaagattcaagtgtttttcttccccatggaaacatttagctgagcaataataggaaaggaggaatatgaaagaagatatggacaactacatctggtgttgtgcattttataattgtgcattaagaaacttctaatcctacagacttgattctaatagaaaccagatacttcggaggttttatctcccaggatgtcttccaggatcataagaaaatcccctacataaccagagaaagtgagg

SEQ ID NO: 9580 - DNA, 406 bp, Homo sapiens
aaatacacattaatgtgaagcttattttctctgctacctaaatgatgaattgacaactagatgattagccacctttgaagcctggttttatgcagagctgcattaaatgtgacacccttcactcagcagtgtgaaaaaactctaatcatttaccaccttagagcttatatatttttttccatctactaactggaatcaagaaaaataaaaaaattcagaagtgatttaaaagcataataaatgcttttaaataatagggaattataggagcccacttcttgtggattgattcataaaattattagcaagcaacgttttagtttgtggacctgttgtttttgcaggctgacccttctctgcaattgaaagaagctgcataattgtaggaaagggataaggacccaga

SEQ ID NO: 9581 - DNA, 406 bp, Homo sapiens; identical to SEQ ID NO: 9580

SEQ ID NO: 9582 - DNA, 466 bp, Homo sapiens; identical to SEQ ID NO: 9579

SEQ ID NO: 9583 - DNA, 1846 bp, Homo sapiens
gggaacctagaggtcctcattttataaagcttttcatgtaaaattcccctgaacaccataaaccatactttacatatcgttgctttaattccttttctttgtgagagggcttctgcaatgttaagttagctaccatataaccatgacctcagtgttctgcaatatatgccttcaactgtttttcatatgacatggatttgagctctcctaccatcctgatcatcttttctgggtgcgtttcagcttttctatgccacataaaacattgtattagaaaccaaaaatagtactaaaggagtggtataagtaggacagagtacagctcagtgctgaaactagcagtaacttctagccttgttggccctttggggcttcacagaggaatggctgtagataaccggagatgttattcggctgggatgcgctaggagacagctccttggctgtttagtccagcatctgtcctgcttggttaggtgtcgcgtttgataggtgagtttcttgatgtcctgattttcaaatatgttaaatataattcttgattttagtttgttcttatttgatttagttctatgtttgaatgctatctgctcacagaggcttccttgaccatcttaactaaaaatccctaccagtcactctctctccctccatcctgttttagttttctttgtaacactcacattccctgatattatattagccttctttctcttctctcctcctcctccctcttcctcttctcttgtttcctcctccttttccttcctttttttcttcctgaactccctgtccttcctccttttctgcctcccttctttcctttctctccatctctttttcttcctccttccctccctctgtcttggattttaagctgcctgagggcaggaacttgttcaggaacttttgtttgttatccaaacactcagaataatactgacacatagacacatagcagatgctcaatacataggtgttaaatggttgaatacatgtccctttacatcctttcccctgcccccagactgtccagttttataatggaacgtgtttgggttcatgccagtaattcatcatgtggttttatgtcctccctcatcctgaaggaagagggacaggtgactgtgttaccattgctgaaggatcatggaggttccagaagctaatgagtgctggtgccttcccagcagtcctgaccatgttacttttctgaatgacctttactgtaatccatccaaggagtccccagcccccacctcaagtgctgttggtaagagagctttctatccaggaactgtgactcataattctgccaggggaagctaacttcttgaataagataagttctcataccagccacattgcgtcaccgtgggagcaggaaacatgttgtaatcccctcagcccatctggcacgtactcatttgccttccttatgaagaggtgtattgtgtctgacagtgatgccacttcctagttggagggagaggaacaaaaaggacatgttgttgacaaaaacgaaaagagcaactggctctgggctagtgggggaagaaagaaatcattgcgcatcttgagggatcaaccaacctctctgcacatgaaagtattgccttttacaaggcatctgtggatgctgacagatttgttggtctttcatgaggctctccctgtgctcaggttcccatctcaacggaaacacaggttgatgtgaggaacaaagcagaaatgttctgaaaaccctaaagcaatctacatgcgtatcatattagtaagacatttattttgttctgagtccttccatgtgggccttttaagagaatcctcaaatataaaaaagaaa

SEQ ID NO: 9584 - DNA, 523 bp, Homo sapiens
ctatgggggaaaaatgggagtgataatagcacaatctgtttttcaaatttgagccagtggtggaaaagttatcagtggtaataatccattgagatgttaaataaaataatgagtttttgtcatattgtttctatataggaaaaagaaaggatctgtctttagactcattctttctctggatgttgctttataagaggaaccagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaactgtaggactgaaaaaaaaaaaa

SEQ ID NO: 9585 - DNA, 19732 bp, Homo sapiens
aaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgctcgcgctgccattggctctggctgagggcgagtccggaacctgtgcgccgcggaactttcggctctgaaatccaagttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgtaagtgcgcagatcccgggctcggggtgcgaccggggtctcacgtggacgcgggttgcaggcctccggcaaattgtggagctgggggaaggtaaggggaaacgtaaaatcgcttttccccaaatttcagagtttatgctttcctaggctatcaaaattttaaaaactgttaaaatttgtatagatggatctctcagttgagtgttactgaaatcactctaacctcaattgttaacacctagaagcttcccttgggcttcttacgcccccatccctctacacacagactgttggtttctccttcctcctatgtgctctcaaagcacttagcgcttagcatactttattgaaagtacgaacttgtcacttgtctgtccaccccccatgactaagcttcttcagaaatagaacttccatgtctcttcccaacacaagcgttttatatgtattttgttgaagaatttaaaatgtgatctatgaaattattactcatttatgtttcaaaccccaacctttccctgagttcccagctcacagcaactacagactgagcttagtttgaattccgtagcacacaactgggatatccacactgtacaacttttaacgatttttaaaattttggtactgtcaagcatctcaaattcactgcgtccaaaatagagctgttgtgtctgtttaatagaattgttgtttctacccacctatactctgccatcccctgaagtccttttcccatgctacacctgtcaagcgcgtctgtgtgaagagaccactaaaacaggctttgtgtgagccacaaggctgtttattcacttgggtgcaagtgggctgagtccgaaaagagagtcaactaatggtgatggggaaggggttgctttataggagttgggtaggtaatggaaaattacagtaaaaggtggttatctattagcagaggaggacggggtcacaaggtacatggtggggagatcataagacttattgtccagaagaagaatgtcacaaggtcgattgatcagttaaggtagggcagggacaagtcacaatggaggaatgttgtaatgttgattaatcaattaaggcaggaactggctgttttatttcttttgtggtttttcggctgccccagacttcttggctcctgcaggccatctggacatatatgtgcaggtcacaggggttacaatggctgagcttcagctcagaggcctgacaccaccacccaagccttccctatctcagtaaatggcacttctgtcttttcaggtactcaaacataaaactaggctgctactttaatgtcttcatttttctctattctatatctaattctttagcaatcctgtcagttctacctccaaactatactcagcatattcactgctctaactccagtctaaatcaccattatcctttcgctggaatgctgcatcaaccttctaatcactgtactttcctcctcctccctcgtccctttctccttccttcgtgtaaatcatcatttcatccctctgcttaaaatgttttctctttacactttaaatgacaaattcttactcctgaaccatgcataatttggctcccatcagtctctccagcttcaccctctgcctccttcacactctagccatggtcacctgtttgtttcctcaagctcacctctagaggatttgcatcttagaggatttcttctgcctggaatacatgtttcccaacctttataagactatctccttatctgtaggtttcctctcagatgtgacatctaagagaggttttccttgaccactgtagccaaagcaaatgttgatcattgaatgaataagtgaacaaatgaatggagtggtatataatgtagcagaattgataatttaaggttaattcactatatatctccaagcaaatagatttataatggttttcctgcctaaaatctatacagccgattcacagatacttggttgacaggttttatatatcagtgtagctcatcagcttatatgttgttgggggccagaatctatacttatacttcattcaaattttattttacaaaagagttgggttttttttatttttattaagagtgctgtgaaattattacctgtaattctaaatctcacttaattcctcccaataggattcaagagggattggcatcaaagttcacttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaaggtaaagttttgagagaagagagagcactttcctcctcaaattagcttttcttctgtttttctaggagagatttaattgtagttagaagatttagtgataagaaatattgtgctctatcttatcagttataaatgaatctgtacttccattcaatttatgttccagttggtcttataattttgtggtagtgttattagttgccattttcacctaataattatttagttattagtttggttattagttattagcttgtagtgttattaagtcagaaagtaatatatacatacaatatacatgcaaatctatatgcatgtgttaatatatttttctatccctaattaatagtttttaatatctttttattttagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacgtgagtattttgaaccatcctttacattgtaagctggaattgcccaatcatgtgtgtgtactcgtagttatcaaatgtgtttgtcttagcaagttctattctctaatatcagatattctcaagatagccagaggaaagtctctgactgtaaagggacattagagatcacttaatgaagaaaaatatctctggtagtagcaatcaaaccttccttaccaggaactttgatttggttttgtgtcaataaaatcctgttatttttgtgagataagagatttgtattatagattgatgaataatttattttctatatgttggacacttttttttctgtttcttacatagcgttttacctaaataataccttttgttccttaataactgaatgattttggaagttctgagtatttggttgcattaggtatataaaataagaactttattaagggaaaatttgtttccttttgtttttctaatggaaagtagtatatttctttttataagagttttggtattgtagggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaaggtaattagtaatttaaggaatttttaatatacttgatattaaccatcctttgaaaactattaaccatcctttgaaaacaaatatcttggccaggtgcagtggctcacgcctgtaatcctaacactttggtagtccaaagcaagaggatcgcttgagctcaggagttcagaaccagcctaggcaacatagtgagaccttgtctctaccaaaaatacaaaaattagctgggcatggtgatgtgtgcctgtagtccagctactctggtgtctgaggtgggaggatcacttgagcctaggaggttgatgctgcggtgagctaagattgcatcactgctctctagcctgggcggcaagcaagaccttgtcttaaaacaaaaaaccaaaaatcttgccatatggaaagcatctgatttgcaaaatcagtgcctgcatttcagtttggggcctgtgagtaaaatagttgcttctgctgggcgtggtggctcatgcctgtaatcccagcacttttcggggctgaggcaggtggatcacttcaggtcaggagttcgagaccagcctggctaacatggtaaaaccccatctctactaaaaaaaaaaaaaagtagccaggtgtggtggcgggcacctgtaatcccagctaatcgggaggctgaggcaggagaatcccttgaacccaggaggcggaggttgcagtgagccgagatggtgtcactggactccagcctgggcgacagagtgtgactctgtctcaaaaataaaaaaatttttaaagataattgtttttttctctgtccctaatatctttatatgtatagcatgtctctcctgataaagctgtcctgtgagcatcttaactgtttccactgttttggaggataccacatatgtcttttctttttctttttctttttttttttttttttgagacagagtttcactcttgtcacccaggctggagtgcagtggcgtgatcttagctcactgcaacctccacctcccaggttcaatcaattttcctgcctcagcctcctgagtagttgggattacagatgcccgccaccacgcccaactaatttttttgtatttttagtagagacggggtttcaccatgttggccaggctggtctgaagctcctgacctcaggtgatccacccaccttggcctcccaaagtgctgggattacaggcgtgagccactgcgcccagcggataccacctatgtctttaaggtgctccacagatttttgtgagtgccaaatagccagaattttaatttataccatcacaaacatatctttcaaagttggtaaaaattgtttctttgtgtcatgatttcagacaagtgaaatttcattaaatttttgtagatgtagtctggctctaataatttggctctatcatttatttaccttaaaatttttatcacaataaaaatgagaatagggccaggcacagtggctcacacctgcactttgggaggctgaggagggaggattgtttggagcccaggaattcgagaccaacctgggcaacagggcaaaagcccgtctccactaaagattaaaaaagttagctgggaatggtagtgtgtgcctatagtctttgctactcgagaggctgatgggggaggatctcttgagtccaggagttcaaggctgcagtgagctatgattgcaccacagcactctagcctgggcaacagagctagagactgtctgaaaaaattaaaaaaaaaaagagaacaggcagagaatgaaagataccaagaatatcaaaagaattgtttttaaaatctaagaatctgaattaaatccatggttgtcagattgtccccagaagatagagaaattctaagggaaaaaaagcaccattataaaatatcaatgagttagtatccttccaccccactcctcccgcccttccccaacaaataaagaaagaaaggtttggttttattgtgaaattatatcagaccttcaagttaagtttcaataaatcaaaaataatttatttcaatttccacatataaagaataaagtagaactttcaacctttttttttttttttttgaaactgttaggtcatgaaaacccaaacctgacagaggtagcattaaaacacacacacacacacacacacacacacacacacacacacacacacagagcacagtctcattcatgaacagtgatgcaaaaatcctacagcacagtggaaaaatgatgccacacaactgcatgaaccttattctcttgaatcagtattagaaaatctagtatgattcctgactgcaagacattaaggagaaaaaacatatagtcacctccatatatgtcagaaagacatttgataaaattcaatattcatttctaattttttttttcactcctagcggaatataaatacatttaagccaaaaactgccatcatgcatgatgcatgcatcattctagaaacatccctttaagatcaggaataagacaagatgtccagtattacaattaccactgttgattaacattcttttagacgcataggccagtgtaactacaaaagataaagataagagatgaggaaaactgccaggtgcggtggctcatgcctgtaatcccaacactttgggagaccaaggcaggaggattgcttgagctcaggagttcgagaccagcctgggcaacatggtaagacctcgtctctacaaaaaatacaaaaattagtcaggcgtggttgcacgcgcctgtggtcccagttatttgggagtccaaggtaagaggattgcttgagcctaggaggtggaggttgcagtgagctgagatcacgcaactgctctccagcctaggcaactgagcgagactgtctcaaaaaaaaaaaaaaaaaaaaaagattaggaatactgcagatgtatttatattccactaagagtgaaaaatgaaagtgttggtatttggagaggaaaccgaatggataaactgaattgatattaggaaaataagagaattctgtaaggtagctgaaaaggctggcattttatacactgaagtcatcattgttgtcttttaaaagttagagataatggccaggcatggtggctcacgcctgtaatcccagcacttggtgaaaccccgtctctactaaaaaatacaaaaattagccgggcgtggtggcacacgcctgtaattccagctactcgggaggctgaggcaggagaattgctcaggagacggaggttgcagtgagctgagatcacaccactgcactccagcctaggcgacagagcgagactctgcttcaaaaaaattttaaaaaaagaagttagagtaagaatttgagtttggagtcaaaagggtcagactccatcagatactaatattctaatcaaagaattacttgacttgcgaatagatagatcacttgaatagaatagagcccagaaacaaactcaaaagcttctgggggcgtttagtatattataaacatggcattttaaattaatcaggaaaagaaattgtttgcagctcaccccaccataggcagcagaaataggaagtcatcgacagaataaaaagatggcaagaacagaatcgtagaacagtacgtttcttgctttcccactttttaaattattttttgcttttacacaaatataagattttattttctaaatgtatactagttattttatctctttcttagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatgggtatggtgccctcttctgtagttttcatgtctgtgctttttccatggttccatttcatacaaagatttggggtggtgtttcttttccctcaactttttattttaaaaacttgtaaacacatggcttggcatggtagctcacacctgtaatcccggcactttgggaggccgaggcagacggatcacctgaggtcaggagtttgagaccagcctggccaacatggtgaaaccccgtctctactaaaaatacaaaaatcagccagatacggtggcagatttcagaatcccatctactcggaaggctgaggcaggagaattgcttgaacccagaaaggggaggttgcagtgagccaaggttgtgccagtgtgctccagcgtgggcagcctgggcaacagagcgacactctgtcaaaaaagaaaaaatcaacttataaacacagaagagttgaaaaaatactacagtgaacacctatatgctattcaattggattcaccagttaccattttgttatatttgctttctctccctagcatatgtaagattgtatatgtgccctttttttaagtaagttgccaatctcatggcacttcacttttaagtacttttgcagatatcgtctaagaactaggacattctcctatgtaatcacagtaccattaatccacccaaaaaatttaacaatacgctaatgatacctaatgtatagtttgtaatcagctttcttgtagtaatctgttttgaaggcttgcatcctgtcatggtccactgattaaattttgaacttcaacctgaaactgtggtcatctcattgacttctttcttgtacccattacatcaaaatgagttttcattttatttcaatggaagagagaatggaaaagaggggaagagtccctgggtaccttgggtaaagtattagcacttactaccatatgtatcctagttttgtggttttcaaacttcagggagcatcacaaggcttgttaaagcacagatagctgtccctcttccccactttctgattcaggaagtatgggggtggcccaggaatttgcatttctaacaagttcccacgtgttgctgatgctgtgggtccaaggactgcactgaatcaatggtctagtggatatctacctaatgaataaacgttgtatatcctttagcacctgtgattacagaggaaaccacccttcaactggaagatatcattaaacagaggataagagatcaggtcagtaagaattaaatttaacttaatcaaaatgtcaccaagatttttagaaataatgtgagagtactttgagagtaggactattgctttttattttcacttagtgttcacaaaccttaaatctaggctacctagtcagcttttgttgtgtgaggtactgctcttcagtagtatccaggaaagacgagtattgtgcctgagaggagcaagaagccattatcctttctcgtgagtcttgctgaccttttgggcggtgctcagtgaagctggtggctgacctgtgatggttgcacccagaacccttggcttaggcacagtatctggtgtggtaaattattcagtatatatgtcctagtcttttttctgttacttataacagaatatctgaagctgggtgacttaaaaggaatacagttatggaggctgagaagtccaaggtcgaggggccttcttaccagtggggattccgcagagtcccaaggtggtgcagggcatcacatggtgaaagggctgagcatgctaagatgctggctcaggtgtctcttgctcttcttaagagccaccattcccccactgatgataacccattaatccataaatgcaactgccattcatgagggcaaaaccctggtgatccagtcacgtcctagaaggccccacatctgagtgttgccacatcagggattaagtttccacatgagttttggaggggacattcaaaccctagcattgtggtagttctacaattttaaaaccatttctcaatggtgtatttttttcaaatgttaaaaacctagtggtttttgttgaagaattgatctgattttgtaaacttagaataaaacttagatatatggcatgtacagtaagagatggccttataacatgtgtataatgtttgcctacacttgtgggtctaaaatagaaagggtttaaagggtgagtatcatgtgcagaacatcttaaaatttgaaatgaaacatgataaactaactcaaggcttgacttttaaacaaactgtgatggggaaatgtggaattaaagttggtaaccaggtaggaagactcatttaaaacagaaaaagatatttgagtaatggtttctttgctttcctaatgtttattctttgtgacttgaatagttatttcaggagttgaaaattttctttttgctataatttgcttactctgtaataagtaataataaatatttattataacaatgatataatttactattaatatattaatgataatttattaatatattgataatatttattataataatattccagaggaagattcttaagtgaacctagaaataaattgtaggttttgttatgttctacctgcactttatgtttcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccaggtgaggaagcctgtaaggccaagccattattattaaagaaatagaagtagagaactaggctttttgtgactgttgaaatcgtgaaacagaaatcttgagctctttggctacctcatgtaagtatgagacagagcatgctaggaatagaagggttctaatattcccgctggatgtgaggggttgaggggggttgctttgcaattagactttggtcacctgatacttttacaactcattaactttctagcaattatggtggtgctacaactttaaaagcatttctcattgatattttgaagtaactgatatattttacatgattatgaattcattctgatttttaggtctgttttttctttcacttaactaaaatctctgggctgggtatggtggctcacatctgtaatcccagcactttgggaggctgaggcgggcggattgcttgaggtcaggagttttagacctgcctggccaacatagtgaaaccccatctctactaaaaatacgaaaaaattagacgggcgtggtggcatgtgcctgtaatcctagttacttgggaggccgaggcaggggaattgcttgaaccagggaagtggaggttgcagtgagcccagatcgcgccactgctctccagcctgggcgacagagtgagactccatctcaaaaaaagaaagaaagaaaggaagaaatcgctggttaaataataggacaaggtcctattcctaggaatattatatgctgatataataatcgaattattccttcacatttgatttattgggaatgtgggtacttagggatcagatggcatttttcttctgcaaaagccatttacgattcccaccagattttgttaatgaatgcccctcagttagcaacagcaaattgccctgatgccactgtgaaactgaagaactgaaaagatttgaattaaaattcttcctggctgccttgcaatccaaggtggtagctgaaggaggatgtgtacagtttcatttgaatctttgaggagattgggtagatacagaaggtatttgatgaccacgagaattaaaaattagataggtaatgcaatagcttatgccagctctaaatgttagtttcatttctctcttagaagtcaacagccagttcagaagtttttgaggatggacttggagttctagtagctaggctagttctagaagtgaaatgatggtaaacagcacatgtaggaccctttactcacatttgtgtatgtaatgtggctcagaaaaatgctgtgtagccaatatatagctacatatttgattttacagatattgttacctagaatgaggtgaaaggacatgtttaggattttttaaagtgtgaggtacgttaaaatagtaagcagtagtagcgtgatgcctgactatggctggaaggtgggtgctgatgatggacattggaaacagacctgaatgcatctctgtcatcaggatcaggaggcaaagagcctatcgtttcctagttctggtgggtttctttttttcatgtcttaataacaaacaaacaaaaagccctcttaggcatttagaataagcatttggggccaaaggggacagagagagaagcatgaaattttctttttctcttcagtagaattaaaattgctgtcagttttttcaatgtgatttgtgagaataaatctttaacacattacatgtaaataaaagaacaaaaaagtccctaccatccaaatgggtatttggataattttatgaagtctatattaacactttacttcttttttttcttttttttttttttgagacggagtcttgctcggttgccaggctggagtgcagtggcgtgatctaagctcactgcaacgtctgcctcccgggtccaagcaattcccctgcctcagcctcctgagtaacaggcacatgccaccaagcccgtctaattttttgtattttagtagagacagggtttcattatgttagccaggatggtctcgatctcctgacctcgtgatcctcccgcctcggcctcccaaagtgctgggattacaagcatgagccaccgcgcccagccagccaccatgctgggccattttttttctttttaattgatgtgagatttatataacataaaatgaaccacttagtgaacaaattgggagcatttaggacagtgttatgtaactactagctctctctagttctaaaacatttttatcagcccacaataaagccccatacgcattaagcagttgctaccctttcctcacttgccccagccccaacaaaccccagtctgcattctatctctgtggattggcctattttgagtatttgatataaatggaaccataccatatgtggccttccatttctgacctctttcagttagtgttgtgttttcaagactggcatttgtcagtgcttcatttcttttttatggttacacggtattccgttgtgtgtatttaccacagtttatctgcttatccactggtggacattcaggctgtttccaccttttgactgttaatagtgccatgtacatgtatttgtttgagtatctatttttaatcctcctggttgtacacctaggagtggcattgctgggtcagatggtaattctctgtgtagctttttgaagacctgccaagcttgttgccactgtggccgcatcattttacattcctacctatcaacaatgcacaagggttccagtttctccatccttgccaacacttgttatcacttgctattttccttttaaaaacaactgtagccatcttaggaatagcttagtttttgacagaagtaaataccaaggtaattaaatttttaagttctgagtattagaggtaatggttactgtagctcctaaaatgcacatcacatctctggtaggtgctggaaccctcatggtactgctgcttttaattttgcttttggaatgtttctttgtagctgaagctttagtgatgagaagttagaaatactctcattgacctttagtgttttgtcctgtgatatatatcaagtcgcttagtttgacattgttgaacttatttcctaagcaaaaaacagcagaagaagaaaatccagaacatgtagaaattcagaagatgatggattccctcttcttaaaattggatgccctctcaaacttccactttatccctaaaccggtaagtgtgttaacagttcagtgtgtagctagagcagggtgaccttcatagctttgatcctttgtgagactagctctttattttgtttcaggatacaaacttgtagtttgctgtaaattccaggcagggtctccatgaggaaagctcacttctggtcccatgacagttctggctctacccagatcttcagtgagcccctgccagctggggctgggcatggtcaggcatcatgctagtactgcctcttactgttttaacttacctcacactttaaaagatcctcagccgtagccacagggactcctcctttccctaccctctcagtcttctgttgcattttcattgtataatgggtttggagatgtatggatatctataccagcatttatggagtatctgctatgtgtcatattaggttctttacatacactaacacttaatgcacacaacactgaggcaggtactatagtttccatttcacaggggagaaaaccaaggtttaggaggtgggagagtgagaactaactctgggcccagctgtctccgcatgatgttccttcaccaggcccagccctctcaaatgctcctcccctgtctgtctgtcacccagacttggctctacctgtctattccttggagcctcatctcctgcttaccagcttctgtgaacccataaaacatgcttgtaccatcctttggtacttgttcacctgttgccctttggtgcctgtgttgttgtctgaaatggaatgtcatgaattaaagactagtctagaagtcagaacctgagctgagttctgctcctaactagctttatgatgcaggcaatcgctttacgtttcatttgtaccgaagagctaatctccaagatcctttattattagttgatggctaggtgattcccatgcaaatattttatcttctcagacagtaagcttttttaacctggttgtttttttttgtttgtttggttttttttttggtatatatgtatgcttttaatccagttgtaattacatgcaagtaagttcttgatggcaggaaccatctttagattcccaaagtccctgctatgggctgtgtaaaataaacaggtgaagagatgagtggaatttctcaactcctcttgtccagcaggtcttactgagatgaaggacgtgggcctttctgggccttacctgtgtgatctggctcttcccacccctttggtctcccttggcttgctacccccacccccactgatcttctgattccttgagcaggccaagtcccttgcgctttctcactgtgctcttcccctggcccagtaggctgcacttcctttttggcatggctggctccttattgcccaggctagacgcctttccctccttgcagatgttccttggctccttacctagggtagactccccttcccaccttgctgcatgtctcaccacttggctccttttcctcatagctgcattgcacatttgcagtcattcgctagttgttcattgctctctacttgtcttcaggcagcacgaaatgcatctactgttccactctgttcctcgcactagctaggatctaacacacggaagcctttagacattccttggaatactgggaagtgaaggagaagtgaatgtatatgtgtctatgtgcccaaatgaaaagcctttcttttttcccttaagaaatgtagaattgctagtgtaggttccccttgatattacttttttcatgttcaggttggtatttcacaccatctctgtagactccatttactaatcacagccattattttttgtggctttttttttttttttttttgagacagaatctcactgtgttgcccaggctggagtgcagtggcatgatcttggctcactgcaacctctgcctcccaagtttaagcgattctcctgcctcggcctcccgagtagctgggactacaggcatgcaccaccacggctggctaatttttttgtatttttagtagagacggggtttcaccatgttagccaggctggtctcaaactcctgacctcaaatgatctgcccaccttggcctcccaaagtgctgggattacaggcgtgagttaccgtgcccagcattttgtggctttttggactgtcttctttttctccatatttctctttaaacactagaatggaacacagtgtttttaataacagttgaacagtggtccagtggaagaaatgatttctttcacactctcatttttctctcacttagaatccaggatcctattgtgtttatggcttgtttttgttctttgtgaagtttccttgagcaaataactccatggacaggatggtgataaggaagaaagaatgctaatgtaactgcaatatatagtcaccattttagttgcaggatcagtatgaaacctgttttaattactggatttcttgggtagttctttcaaaaaaagacaaaaatctgaagcagatggtccttcaattaacattgcattctttccccctttttgtaattgatagctttgatttattttgatactgtttgagtttttcagtattatttcatatttgtttatagagatgttttcagtagttgaaagatgaggaaatttatcagtagtctatttttgactcttgttcccgtaagcatctttccttgcatctttttccatatacttcttagagctagcttttttttctgtaagcaaagtcaagataatattaatagagatcagtaaatcttaccaaacagcattaatggttgtttgagaatgtccacatgcatggtagataggaatagttgaggaagagatggaagaactgatgtttgaagatggcagaaatgttatgtaaaaatgtagaaaacgccgggtgtggtggctcatgcctgtaatcccagcactttgggaggccgaggcgggcagatcacgaggtcaggagatccagatcatcctggctaacacggtgaaaccccatctctactaaaaatacaaaaaattagccaggtgtgatggcaggcgcctgtagtcccagctactcgggaggctgaggcaggagaatggcatgaacccttaagagggagcttgcagtgagccgagatagcgccagtgcactccagcctgggcaacagagcaaggctctgtctcaaaagaaaaaaaaaaagaaaaagaaatacatgctgttggaatggttttgagacagaaaaccctaaaatacccaggtctctgggatcctgaagcagtgctgcccctcagcactgccgtcatgccagtccacttaggactttggctgtcaccatatctaacattttaaatagtctccattaggtttgctgactttcaagcaagtgaaaaaaagataatctccataaagtattttatatattatactttaagttaataggttcacagttcacacattttgtgttagagtcccttctggcttcccattgaatgtattatctcttttctagcctgtaccagagattaaagttgtgtcaaatctgccagccataaccatggaggaagtagccccagtgagtgttagtgatgcagctctcctggccccagaggagatcaaggtaagaagccaatgttgaaaccttaaatgtctgttacaagttagttgatcatagccagactccatttatttgacgtcatttgccttgcacttgtagttcttattccaatgtatctcagcagtttctaagtataagcaaactagtaatgttataatattcaaataccagtctcctatattctggctttattatgaggtacaggtttgagagttactgtaagagcagttttaaaatagctagtatcaatatcttattataatccaatctgaatactagcagtgatgttaagttgaaaacaaatggcttgcattgcatatatactagcaatagtttagtgtcagcatttcccccttattttattcatgtaatgctaattagtaatggaatctgaatctagaatcgagcatttggttatcagaagaggctagatatatcaaatgcagcaatccctgccatgtgaacattgaagcttatgccttacacagtaataatggtttctgccaggtgctcatcttcctggctggcttagcagcagggccttctttttccctcctcacttgatttgctacacctacactcaccccttctgtctgagcctctgccacctcagtgcaggtgacagccctggcaggataggctggcagctgaggagaaaagagatagaattgatcctcactagagagatgtttcccttcccttcctctgttccttggtctctgccctctggcctcagtccagttgctgtcattagcagctcagagctgaggctgcctctggcatgtccctgaagcccattggaatctaaatgctgtggagggctggctcctcttgtgctgttaggttgagaacccaactctccatgttgccttcttgtgaattagtttgggaactgaaccgtcactataagagtctgtgcctgtcaaagaatgcatttcaggttttaaagagctgagttaccaacgctcattggaatgcaggtggggattgctctgcatctttgtgcatttggccacagatgcacagcctgcttgctggctaccctgcagtttcttccattccagtttcctagttgttaaacttgatgaatgaatatgttggtggttatttttttaataggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggtaaggacaagggaaagaaaactgctcaaggggacctttgtgggggaagtggatagcaagtgctgggtgactggaatgtctgagccagctgacagcccacctgcgggatagagatgcatgatgctgactggctggaatcgcaacctttaatgttctagaatttttcatgtagggtcctcacaataacctgggtcctggcagcagcttgtcttccactcctttctctcttagattataagaacattgtagcagtgcagaatacctctatgctaactgattcagttttctgtaattctagtcctttttcatatttatggttgcatacattgttgtaatggtgatgtactatttttggcttttttcacttataagtacattttacagcataagcatgtggtgtttttaattgcaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttcc

SEQ ID NO: 9586 - DNA, 21299 bp, Homo sapiens
caatgttgtaatttttactttaacttttaaatgaaaagtataattggatattatacttgtcttccataacaagttcaatgtctacatatctactcatttactcaacatccactcatccatgaacttgttagccacttttccatccactatgcattcaatgcatccatctgtaatccttgaaattcatctgaaacttgtttctaacatatttgagtctgactatcctctgagatctattctctctttcctttcctttttaattcattcagatgttgttttgtaagtgtttacatttatttcaagcagtactctccccaaatgaaccataagcatcttggcagtggatttctattcattttgtatattcccctaggacctgttgtggtgttctagcatctacgtgatacctaactctacaaattactactgatttaaaaaaataattcagacatctacatgcctactagatgacgcaccaggttttccacaaaacttcctatacatctagccctagcacccaaaacacctggaccctgaggaaactgtgaccacgagttgtttttgaagagcaaaacttctgagattaaaattccctaatcttacacagcttgctctaaaaaagtattccaaaacattcttagaaacttttgccccaaatattagccacaaaattgtcatactttcataactcctttgtgtatccatccatcacacacatacccttgtacacagctaacacattacattcaattaccccattgtagaagaggaataatttatttctatatgattttaataatgttccctaagtaattagtaatcaagattttcttcaaattcaaattaacaaatatgtttgttaatctaaataatatacatatttatgtatttatatatgtatatattttaatctttctgtaattcagtctttaactgtgaacttttacatgatggaagcagtgaaggactcaatgtcatagtacattttgatagtatttgataggctttttcaggtcaattaatttagttgcttgcaaatataaatcaagcttgctccagttccacaaggactccaccacagtctttaggatggagaaaaatcactggttttccatgtgctcctattttgacctcttcacttagactgcggatcttcttttttttcaaatccatcacagctgcattaatattatccaccttaagaaagggaaataaattgaacacatttgagatcataaaaataccaacttatagtatcataagacttagaaaaaactttgagagctcatgcagtctatctcctctgcctgtgggcaggaccattcttaaatcatcataaaaaataagcttaaaattttcagagaagtaagagaagttactaaatttttctaggtaagcaaccacaatgctcagaattttcaccattagtaaatgtttcttcttataatctaaatcatgtatgatatactttataatagtttattctggcagtactattagtgagattgaagacattgctttttcctgagaaccctgggtcctcatctataacaggcaaatgaggtctaccacataaattgactacagattaaaatgaggtaacagataaaaagctttcagtacagtttatggcataataggtacttagcaaatatgagtgtttccctgatccccaaaacttgccctgccaaaacacctggttattacctttgacattatcaagacacacatgaaaatcactattaaattgccatcaaaatgttattccccacccaaaaaaatttcaaactttaatgtttttgcagcctcttctaagttatttctattttcttcatacttatggacactctaggaggagcagatgtgtctctctatacttgacggagaaatgatctgcctctatcttggaaagtcacccacttagactgggaacctaagaaatggatgaaaaggtatgatatgaatggccacattcctaggcagtcataaatcactagtttaattaaaatcactagtttaattaaaaaaaacacacaaaagcacagagactagtttaacacccatgtacctaccattcagatctaataaatattagtatttatacaattttatttccaaagagccaaggattatatgctgaattctaaaaccagtcaaacagctaatgaggatactaaatgttacataaataagctatgatttcttcatatggcacatattctacttgtattcctgatatttcttttttaaacctcatagatatgtcaaagtcacacgtgcctagattctgaacacagctcatttcatgacatcttgcactgtagctggttaattctcatctttttcagaatagaacatgcactagaagctcgtggcaggaacggctcgacccacttagtgaggaaaattggtcctcactgatgtcagacattgtcaattttatcttatttttaaattcatatcaatattattaagcttttcttctgctgcgttaggtgggattggagcagcttttagtctaggactaattttcctcactaccaagccaaagcccttctgagtactcttcccaatgttacggaaattactatgactagtaagaaaaaactatccccacctctgtgtgtggattattccctctaatcctttcaaggggttctattctagcttcctaacatgcgtgcaatactcgaagctccgatgaagacatgaaaggtactacagatctttagagttcactctctgtgcagctctcctttccaggagagagctgtgaactctagcaccatggcctcctcagacttccaactcctatctccgcaactcagggagaccactaagttccacgtggattcccccttcctgcactgcagtctggaaactctctacagccagtaaactgggtaattgtagggctcatcttgtttgtttaccctctctcagaaatcaattcctgtgctgcctgatgtccaatgccagaaatccattatgtcatgtattttgtctaggttgcttgtttgtttcagggaggataaactgatctcttttacaccaacttggccggaatcagatttctaaattggcaggttttttctgtcagcaactaaaaagtgtcattacatgtcattctataatatgtcttttttactttgattgcttttaagattttcttgtcatctttgattttcagtttgactatggtgtgcttaggtgtggttttctttcttttgagacagagtctcactctgtcacccaggctggagtgtagtagtgcgatctcagctcactgcaacccctgcctccagggttcaagcaattctcctgcctcagcctccagagtagctgggactacaggcacacgccaccatgcccagctaatttttatatttttagtagagaaggggtttcaccatgttggccaggatggtctcgatctcttgaccttgtgatgtgcccgcctctgactcccaaagtgctgggattacaggcgtgagccactgcacctgccttttttttttttttttttttgagacagagtctcactctgtcacctaggctggagtgcaatggcatgatcttggcttactgcagcctctgcctcctgggttcaagcgattctcctgcctcagcctcctgagtagctaggattataggcatgtgccaccatgcctggctaatttttgtatttttagtagagactgggtttcaccatgttggccaggctggtctcgaactcctgaactcaagtgatctgcccgacttggcctcccacaatgctgggattacaggcgtgagccactgttgcccggcctggtgtagttttctgtttgccctacttggggttgctgactttcttgaaaccatagagtgatgttttacatcagattggtagtgtccttgtcaactattttttcaattactgcttctgttctattttctctctcttccttttctgggactccaactatattctgctagaacttttgaccatgtcctacatctgtcttatgctctattctgttttctttttcttccatattttttacctcttgattttggaattctagtttctagaactgtgaaaagaataatttctgttttaagccactaagtttgtgatcatttattatagcagccctagaagacaaatataactaccacacatcataccgaaattgaacaacgaagtagatggatggctgatagtgggagctaagtttctcactgttggaatgagaagataaaggctagtgtggtctatgtggtaatggattagagctggagacgtcagtatgctctgaggagtttatgacatttcatgaattctataatatagttatatacagaaatgtgtatagatatgtgtatatatacagtatacacacatatatatctccctgttgtcctggctcagtagggcaagaaccaatgacacacccagtagcaataagcacacttagaacctagatcttggcttctaataccattctccagtagtaggaaccagggctcctagatgaaatgtctaattatatggctagggcaaagagtaaagaagatgaatttggagcatctcatatagaagatgaatttggagtatcttacagtgccagaaaaagaaaggaagtgcttaaaaaacaaacacaaaacacaaaaccaaaaatgatcggggtatgtcaaagggacataagaatcaactgaaagagctcctaatggccaaagctggaacaatctgaggggaaaaaaagtagtattagattgtaatgcaagtcataaaataaatatccacaagtccatactgatataactctctattccttaagtgtgggccttgcataatgacttccttccaaaagaggatagtatggaggagaaaaaaagaacagctttccagtggagaaacctgacaacacctcctcacctgggagatcaaggttaatatcaacagtagtaagtcatgttgatagtatgaatccttgatatgatgtgatgaaaatgacactttacctctatggtcttcccaaaatcaataacatgagtctaataagaaaaatatcacacaaatctcaactgagggacagtttacaaaataactgaacagtaatcttcaaaagtgttaaggtcatcagaaacaaggaaaggagatcctagaaaaaggttagaaaacaaaacaaaacaaaaaaacaaggaaagtttgagaaactgccacatgcaagaggagcctcagcagatacgatgactaaatgtgatgtgctaggggtggaggagtgggggaagggagagcatcaggataaatagctaatgcatacaaggcttaatatctaggtaatgcattgtcaggtgcagcaaaccaccatggcatacgtttacctatgtagcaaacctgcatgtcctacacttgtatcctggaacttaaaataaaattaaaaaaaaaaaatgtgatgtgaaatcctagatgggatcctggaatagaaaagggacactgggtaagaactaaaggaatcagaataaagtacagactttagctaataacaatgaattggtattggttcactaattgtgataaatgtatcaaactattataagatgttcataatttttttaaagcatctgatgagattaaccactgtttataatgagtggatcttgtttttatcctgattagagcaaatcaactataaaaagacatttgtaaatcaatctgggaaatttaatttatgagctgtgtatagatggtgccaaaagatttccctttaattttgactgaagtgccagaaaataaagatgatgtcaccgtggttatttttgtatttcttagagacccaaactgagtaagggtaaaatgacatgttgttcatttaaaataatttaaggaaaaaagaaaaaaagatgacgtgtagcaagagcttgaaaactgttgaacctgggtgatgaaagtactgacatgattttttttctacttctcatatgtttgaacaatttcatgatataatcatgactttttccatagtgcccttttgataactcctatgctacatgtgattatgaatattttcatttatggaacattctatccaagtacaagtatctataattttgacattgcaacccaatgttttagtatactccttcttcaatatccctcaatcatgaattacttcaagcctgggcacagtgtttcatgctgggcacagtggttcatgcctataatcccagcacttaggtggggccaaggtgggaggatggcttgaacccaggagtttgacaccagcctgggaaacatagtgaagccccatctctataatcaatcaatcagtcaggtgtggtggcacacacctgtagtcttagctactcaggaggctgagatgagaggactgcttgagcccaggttgaggctgaagtgagctatgatggtgccactgcactccagcctgggtaacagagtgagaccctgtctcaaaaaactaataaatgtctaaatgacattgcactagcatctacttctacttctgttactatttctatcactaacttcaattttaaagctcttttaccatatttatccttctgttagtgttgctatacattttatgattcttttaagagtactcctaatgctttgtttggcagtaataaaaagaataaaattaaaatgtcttaattttctgaattgaaagtagatgcaatagttgtaagaaatgcagagcaatttgatttgggaaattaaatcagtccctctaagtaaggatgaaagtaacacagtcagtaataacccatcttttaaaaaaagggaggttttcaaacactgcatgttctcactcataagtgggagttgaagaatgagaacacatggacacagggtggggagtcatataccggggcctgttggggggtgggggaaagggggggataacagtaagagaaatatctaatgtagacgacgggttaatgggtgcagcaaaccactatggcacatgtgtaccttatgtaacaaacctgcacgttctgcacatgtatcccagaacttaaagtattaatttaaaaaaggggggggttatggttttttaaaactgcttttatagtccttcaaacaattacagagtgtaccatatagttctggaagactttgcataccactagtgaaaatcggggctatttacttttcttttttttgagatggagtcttgctctgtggcccaggctggagtgcagtggtgcaatctcagctcactgcaagctctgcctcccgggttcatgccgttctcctgcctcagcctcccaagtagtaggtgcccgccaccacgcctggctaatttttttgtatttttagtagagacagggtttcaccgtgttagccaggatggtctcgatctcctgacctcgtgatccacccgcctcggcctcccaaaagtgctgggattacaggcgtgagccaccatgcccggccctttacttttcacttcaacttcttaccagctatttcctttttctttctttctttcttttttttggtatttatctgtatctgagagtttatcttgattctgccccttcacctgcaaattaagagtgacaataacccgaataaaaaatgtttggattgtcacaatcagaattcaaaactttttttttttttttttgagatggagtctcgctctgttaccaggctagaatgcagtggtgcgatctcagttcactgcaacctccgcctcccaggctcaaggaattctcctgcctcggcctcccgagtaactgggattacaggcgcgtgccaccatggctaatttttatatttttagtagagataggtttcaccatgttggccaagctggtctccaactcctgacctcaggtgatcctgcctcggcctcccaaagtgctgggattacaggcgtgagccactgcacccggccagaattcacaatcttcaggtacatctcataacctctttggtcctcagcttccccatctgaaaatggcaatacaatcttgtttatttcaagccaagtaattgggctaaataactctaaccttaaggtatgtaatcctcaatgaccaaattttatgaaaaagtaataatgtacccctcttaactatacatgacatttggacagatttaacaaacataagctttaattttatatacagttgtaatggtgctgatataatgaatgacttcaatcctcaaattggtataaatccatgaaagttaaagtgaaaagtctggattaagtatttgttgtatttgttccaactgtatctcctcaaaagctaaaagctgagtgaattatgcaagcctaacactgtctcactttacatagggttcagatggttccagtcttcttggatttatttcagaagagcacatgttacctaagcttccacaatgactatatagtctagtgggggctatgtggagtatccatcaaatgcttgtctctgctgaaattttcacagtggatagtaaaatatttttttaattccctagtttattgtgaaaagccaaaatgagaataaaattttttaaaaaggagaatattttcctttcttgattgaagaacaaacattacccagtatgtaggaaatgagttacctcactagcctgttactttgaagttataaattttttctttcctaaggaatatatgctgtcaaaaaagatctgcaaaacatataaaagcacaaacaagaaaatgagtcatctattgtctaatcactcagaaaataaaactgctataattgctgcatttctctaccttttgtcttagtttttaaatactattaatatttttctcatgtgcttttccccagcagcctgcaacagtaatttcaagattaccttgaaatcaaatccaacatctctgtctgccactgggaagccaggctcccatgatccttactacctactcatctaaccagccccttctctgtcaccggtccctatgattctgcagcccctccctcagcctcagcactgcactcatcaccctccatgtgctccaaccgtggggctgccctcttcatcccatctgagctcccactcacaattccaggccacaccacccctgcacagaggcctgttaccccatgtgagctgggccactccctgtgctgcagtcctccttgccttttgtgggattcaacatcccgcccggaagcgtcccagtggatacacatcctcctcaccctgtgtggctctgactccccatacctgccccctaccccatgtgaacatctgcctcacccttctcaggccctgctcccataccaggccactccctgcgaggacacccagcttatcccacctgggcttcaactccccacattagtcaccattttcccctgcaacgatgcactccccacaggaccagccctggccctccatgctgggcgtgccctccccacagtgtcggtgcccctaccctgctctggctctcccactccttgctgccgctgcccctcaggtggacgctcttctcaacatccttgggctccagctccctgctctgagctgtgtctcagtccattcgggctgttagaacaaaatacctaaactaggtggctcagaaaaaacagaaatttgtcagtttgagagcctgggaagtccaagatctaagtgctggcagattcaacatctggtgggggattggtggttcacagacagcaccttctcactgtcctcccgtagcggaaggggcaacgggtgtctctgaggcctcttttataaggacactaatcccattcatgagggataggcctactgctcatgaatgaggcctcaggaatcatctccctaaggccccacctcctaacaccatcactttggggttatgatttcgacatatgaattttgaggggacataagcatttagttctaagctggcctcccatgctgatgccctcctcactctgacactgcaagtcaagatgctcccttgggcacaaacgcacaaaccctgctcagactcggacaccttgcactggaactccccatgcatgggcactcagtctctggcttccccggggcaggcagctctcactcatggatgccctcctcaccttgccaggatcccaacaccctgctttaggccagtctggttctccccatcaacaaaaatgactcttctgctctgtcctacctgaagtcttcaggaagggaaggaatggggaggagtcataggtactcaatactgtttatttccttttttgtttttggtaagtagaaagaaatacagtcatgtgtcacttgatgggtacgagtcctgagaaatgcatcactaggcaatttcattgttgtgcgaacatcaccacacctggatggtggcgcctactacacacctaggctacagggtacagtctattcctccttggctacaaacctgtacagcatgttactgaaaactgtaggcaagtgtaacacaatggtgtctaaacacatttcaacacagacaaagtacaataaaaatacagtgtataaccttatgggacctcatgtggactcatcactgactgaaacattgttatgcggtgtgggactgtatttggctaaactagtaaggtatgctaatcatcccttatatttcctctttgttgcaactagcactattacttctgtttatccttttgtactttgtaggctgtgttttagtcagtcacctttaatcctctctggaaaatgaggagcatgtgtgaataaatgaagcaagcaggcaagctctgggtagacaggaactttctgcttgttcagccacatatccccagcatcttgtacagtgaaggacagagtgataccaaaaatacttaacaatcaggaaaatacaaagatactaatcagatagaattgtgcggctgagcatggtggttcatgcctgtaatcccagtgctttggaagggctgaggtagaaggattgcttgagccaagagtttgagaccagcctgggcaatatagcaagaatttgtctcttaaaaaaaaaaaaattagctgggcatgatggtgtgctgcctgtagccgtagctactcaggaggctgaggtaggagggtcgcttgagctcaggagttccaggttgcagtgcgtaatgattgtgccactgcactccagcatgggtgacacagtgagaccctctctctgaaggaaaaaaattgtagagggagaagggtgtctgaagggtcccagaaaagggtccttctggaaaaggaatgttactcaggtgttacagagcagcagctgtttaccaaccaacacggaagcatttaaatatttttacaaactcaatacaaatttgagtaagtatttctggtggcccttaaagtcttcactgtgacacactgtgctgtctggctaagttctccagagaaagcacggccagctttgtctcctcaagcagaggcacgcagaaggcagggaaggtgacccccctcttgccatcgcaggcagcagttaggagcacaaacacaagctgtgccagaaaacagtgggtgattcagtccatacttgagcaagagaagagatgggacaagatgccctctaaaattcctctagtgagaggcaaagacacacaagaaatatgagtaaacctcacaagaaaaagtagaaaccaactcaacctcgacagaaaaatgctaattaactattgagatcgtaatccacatgtgagaaaggaacatttcgtcaagtgagtcaacaaaaaccatggagcatgcaccaacagatatatgctaagtcagaggttttataagatcctggtgaaaaaggacagaaagtagccctgtgattacagaggggaaagccaattctctgatgagtggttcaacattttttttttttttcctgagatggagtcttgctctgttgcccaggctggagtgaagtggcatgatcttggctcactgcaacctctgcctcccaggttcaaacgattctcctgcctcagcctcccaagtagctggaattacaggtgtgcgccgccacgtccagctaatttttgtattttagtagagatggggtttcaccgtgttgcccaggctggtctcaaactcctgagctcaggcaatctgcccacctcggcctcccaaagtgctgtaataagcatgagccaccatgcccaggtgacacaccactttttaaaaatcaccaagcgtggcatccattgatggcctccagtacctttctccttttcctccttttaattacagcaacccccaagcttcagcagggcacataactgcctagctagagactacattccccagcctcccttgcagagaagtgtgtcatgtaactaagcttgggccaatgggataaggacagaagtgatcctagagcatctccttaaagccacttgccaggtattcccactccaccttcccttcccttccctctggctggcaaatggtgatgcctggagcaaccttgtaagtcatgtgtcatggacagcagagctgcccatcagcctgggatagctaatattagactgaaaacagaaaaataaaatcttgttaagccacttaatttttttgtggagggcagagaatgatgatgggggtattatactaaaatagcacctaactaaccactgttcacaccttctcctcttacctaccttcattttatatccaatacatttgcatgtcccccttataatctctgcttttgaatctgccattactgaacttccactattccttacttaactgaactaaatcacatagctgaactcctttgaaagcatgggctctcttgatggaatactgatagtgcagtgtgggagaggggggagtggattcaaaggtcctgcttctcatcctggggggtggggtagggcttagacaaacactcaggtccactgacaaagacctgcagccaaaagtaactccctaaaaataaaataaaggctaatattaggacttgtttagttccctgcttaaggtcttatagcttccccaccgcaaatttaaaactcagttaatataatgaaggcaactggcatcatgggtaagagtgcagaccctggaatcagaaccaatctgggattcagccccatacctgctattgatatgaccatgggcaaattaactactctgtctcagtttcctttcctgtcaaatggggataatagggccctcacagggtagctatgaaaattcaagaaaatagtatgtgttgagttactttgtagacatactactagaggactcactaaatgttagttcttttttttgagacagggtctcgctctttcattcaggctagagtgcagtggtgtgatcacggctcactacaacctccacctcagcacttcctgggctcaagtgatgctcccacatcagcctcccaagtagctgggactacaggtgcataccaccacacctgactagctttttgtatttttagtagagacacggttttgccatttggcccaggctggtctcaaactcctgggctcgagcaatctgcccaccttggcctcccaaagtgctaagattacaggtgtgtattagtccattttcacgctattgataaagacatacccgagactgggcaatttacaaaagaaacaggtttaatgatttacagttccacgtggctggggaggcctcacactcatggcagaaggcaaggaggagcaagtcacatcttacatggatggcagcaggcaaagagagacagattgggcagggaaaatcccccttataaaactgtcagatcttgtgaaacttattcactatcacaagaacagcacggaaagacctgcccccatgattcaattacctcccactggtccctcccacaacatgtgggaattcaagatgagatttgggtggggacacagccaagccatgtcgaggcataagccaccacacccagccactaagtgttagctgttatgataactctatgcctttccacatgcaattccctctgcctgaaataactttctccttttgttcacctagggaattccttcacattcattgtaacttatgctctgtgaggccttcccagcaactcaatctgccaggagcaatcaatctccttcatctgtgctactgcaaagtcacatatatcaattctacttatcatagtatattgcacttgggtgtttaaatttctgaccctcctcactatggacatgactcatgtcttattcactgctaaatcccaagtacttggcagaatacacattatagggtctcatacatgtttgcaataatgaactgaatacatccttgaattcactctagaatcaaatgacctctcctctgtattagaaatttggcctaacaggccaggcaaggtggctcacgcctataatcccagcactttgagaggctgacgtaggtgaatcacctgaggtcaggagtttgagaccagcctgaccaacatggtgaaacctcatctctactaaaaatacacaattagccgggcatggtggcgcatgcctgtaatcccagctacctggtaggctgaggcaggagaatcacttgaacccaggaggcagaggttgcagtgagccgagatcacgccacactgcacttcagcctgggcgacagagtaagactccgtctcaaaaaaaaaaaaaaaaagaaaagaaaaagaaatttggcttaacaattatgtcattctttctataaaaagaattgtcctagcaaattaaatcgatgcataattgtcattgctgatattctaaaaggcagttatctgaacatgaacatctatagaaatgttctctaatggacttttcttgtctaacatttcttcacattcctttaaaaattgttggcaggtgcaattcagaagatcttaaaaattacagtaattgaaaatgtattgactttgtaataacgaagaagttattagcattttaaagagagaaaagagttataaagaatacttagcatgtacactgaaagctttaaagtcttttcatttgtttctcctaattgccttatgacagtgaaaacagctgtattcctgttacatgggaggtcaaacatgatcaattctaaagcagactctacattgtggctaactttggtggcacttacagtggtcactgaatccagacttcaaaaaaatacattaatattatatgttagaattttctaaagggaaaagaaatgtatgtaaggatccacctttgaggaggatgaatattatcattctccttaaagaactttacaaaagtttctaatgacagtgaccataaatagacttaaaaagtagaagacattttttaaaagagagatttaaaataccaggcattaaaataattaaaatacctcgatgcagatgtgatgcattcctccagccttgtttttctgcagaaaacctgcaattggactgtcacgtcccaatggatgaagcagttccatcttggtatttcccaggttgacaaaaacaacagatactccatgttcaggaagagggaccgcttcacttacctgggcccccagaatattcttataaaatgctgcagccttttccaaatctggcactgctatggctacatggttgagtcgacccaggttccacacagaacctgtcacttgatccaagggctgtgatgtggaagaagctcttactgttggaatgggagcttgaagtctggaaaaaagccctgaaaaattgaacagccattgatatccttcttttgagaattaacgcacttctaaattgaattttaaaaactaaacaaataatgcatgcaaaaattcattatttatatatctgttctttttaattattgaaatgaaaccaggagataaatggaaaaacttacatcagaattactctgctctgcccattcaaataactgactggaataaaaaagctaattctgagctgcagttagatttaaaacacaggataacattttttcataacaattcatatttactggtaacacttaaatagtggcatattaagcattacttgctattctctgcatttcacaatgaaacaacatatatttaataagagcaagcaatttctctacctgtacccaattttttgtcttatattttgtaataagttcattaaaggtataaatatacattaaaagagtacatacagtactctttaatgctctgttgcccaggccggagtgctggagtgcaacagtgcgatctcagctcactgcaacctctgcctcctgggttcaagtgattcactggcctcagcctcccaagtagctgggattacaggtgcctgtcaccatacccagctaatttgtgtgtgtgtgtatgtgtgtgtatatatataaatatatatatatatatatatatatttttttttttttttgagacggagtctcactatttcgcccagaatggagtgaagtggcgcgatctgggctcactgcaacctccgccccccaggttcaagcgattctcctgcctcagcctcccgagtagctggaattacaggcacctgccacatgcccggctaatgttgtatttttagtagagatggggtttcgcctcattggccaggctggtctcgaactcctgacctcaggtgatccacccacctcggcctcccaaagtgataggattagagatgtgagccactgtgcccaccctaatttttgcatttttagtagagatggggtttcaccatgttggtcaggctggtctcaaactcctgacctcaggtgatccacccacctcggtctcccaaagtgctgggattataggtgtaagccaccattccagtcagtttttagcatttttaaaattcactgtcgctgtgtcctcatcagatagtttcttgatctccacagataactctgcattccattcatttagcaaacagtcattgcatgtcattaacaacaagaatggcctgaatttactgtgcacctactgtctggcactgtatttatttttttacaccaactatctaatattcacaacaaaccaagttagaaacttagtaagtttcattgttatcatgaaatccaagtggattacaaccgagtacacatatacataaatgtacaattgaaactaaattgcaaaaaaagaataccttccacctcagcctcctgagtagctggaaccataggcatgagccaccatgcctggctaatttttgtacgttttgtagagatggggtttcaccatgttgcccaggctgcccatgttgctcctgggctcaagcgatcctccgaccttggcttcccaaagtgctgggactacagatgtgagtcacagcactaggccagtgaaaatgttttgaaatagacaaatgtgatagttgcactaacccagtgaatgtaataattactgttaaactgtactttattatttatttattttgagacgaactcttgctctttcacccaggctggagtgcaatagtgtgatctcggctcactgcaacctccaccttccgggttcaagcgattctcctgcctcagtctcctgaataattggtattacaggcgcatgccaccgcacccggctaatttttgtatttttagtagagacagggtttcaccatgttggccaggctggtctcgaactcctgacctcgtgatccgcccacctcggcctcccaaagtgccgggatcacaggcatgagctactgtgcccagcctaaactgtacatttttaaagggttttgttatgtacattttaccaaaaaaaaaaaaaaaaaaaaaaaagatccaacaataaaaatccaaaggtgaaattgtgtagaccaagcaaactgggtagagaacactgaataaaggagttaaaaagagacagagctttatatttaataaaaatgtgttcctgaaaagtttgttgtgaattgaactcttaattattatatttctcctttgacttgtagaaacttttttccagcttgaggtatgatgactaatagaaacggtgtatctttaaggtatacaatgtgatgttttaataaatgcataaattatgaaaatgattaccaacactgaagctacctttttaaagctatttttatttcaggttgccctccaactagcaggaattcacagctctttagttttagatttctctgcctcccatttcagaatagtgcagcagaattgcattattttgaattctgcaatgtttaatttgtgattattccaataaaggttgctttgcatgaatatactacagtgtaaaaccatgtgcaaataaatgcataagatatttaaaaacagaagtgttaataaaaaacgcatgtaaagatgaatacagattaaagaaactattttcacatgtcaggaagctggtatacaagtaaaagatcaaaatcggatgtgtatgttaactctcattccaatcttcctttcaatatcaattctcgttaatcacttttagtgtcctgacttaaaaacaacattgcatttctttcagttcagattttgcatttatttcagatcacactttttagacactgtccctgaatacataaaggtttagctgcaaggatctatactcaaatgcattaagagtacttactatttaaagacattagatgttaaatttgtataaaaagtactataaaagtgaataatcacttgtaataggttttttaacagctttatctcttaatagtttttaaacagacttaaaatttatataccataaagttcacccatttgaagtgtacaattcatttctttgcatctttgcaaagttgtgcgaccttcacataatctaattttagaacacgtaataagtttgtttgtttttttgaaacgagtctggctctgtagcccaggctggagtgcaatggcgcaatcttggctcagtgcaacctctgcttcccaggttcaagcaattctcctgcctcagcctccggagtagccgggattacaggagcgcgccaccacgcccggttaatttttgtatttttagtagagatgggttttgccatgttggccaggctggtcttgaactcctgacctcaggtgatccaccttcctcagcctcccaaagtgctgggattacaggcgtgagtcaccgcgcctggccgaacataagtctgaattttcactgaatatctggtttgaggaaacatacgtatttagaaagtcattcattagaagtgctttcaagttagtctggtaagttttctcttaaacatttgaccagttaatttcacagcaccatatatatatcttcaacttgtttcaaactatgatcaattttttttattcattacagtaagtaaacagattacatttctgttagcccatttacagacgattaatgaaagtaaacctatgcagtcatgtaagttggtcattcttgtctcccacctaacaggttcaatttccattttcagaacttttctacgtgttcactctgatttttctgtgcttttgtttttcggcgaagttttatgttccttaaaagaggggccataacatagaattaccatgtaatccagcaattccacttatgagtatacacacccccaaagaagcgggaattcagaagtatttgtacacccacgttcatagctgtattacaatagccaaaaggtggggataacccaaatgtctatcaagagacgaatggataaacaaaatgtggtatacacacacaatggaatattattcagtcttaaaaagcaattttttttttttttctgagacggagtttcgctttggttgcccaggctggagtgcagtggcgcgatcttggctcacgccaacctccgcctcccgggttcaagcgattatcctgcctcagcctcccgagtacccgggataacaggcgtgtgctaccacgcccggctaatttttgtatttttagtagagacgggctcacgcctgtaatcccagcactttgggaagacgaggtgggcagatcacctgaggccaggagttccaaaccagcctggccaacatggtgaaatctcgtctccactaaaaatgcaaaaaattagccgggcgtggtgccgggtgcctgtaatcccagctactcgggaggctgaggcggaagaatggcttgaacctgggaggcagaggttgcagtgagctaacgccactgcactccagcctgggcgacagagtgagactctgtctcaaaaaaaaaaaaaaaggtaaattttactttatgtatattcaaccacacacacacacacacaagtggagacattaagcttcaagtatcttaataggacaaatcaaaggcaatctttggaatacactgtcttcatttttcctttatgccaagatgtgtatgtaagtacaaaacaaacatgcacctttatctgtattgagttcttgcagtatgtatatgacctgttggaagtcatactttttcccaaactgtcaatcattaaagtgtgcagttctaaaaatagacataaaaatgccttttcccaaatattcatttatttatagttttacgttcctatcttgtgtatcacctaagaggaaggtatgccttacggttaagaatgtgggctctggtgctagaaggatttatcacgaatgtcccggagtaactctggggcattaccacttggcaccttcttcctaatagggaatctcagattaagggaaatacttgccctctcataaaaggaggaagagaaaaaaaaaaaggataaaaagaggagaaagtgagtcagaaaacgtgacaattattacagttatttctgtcataactgattctatgtacatattttaaaaaaaatgaagggggagagaactcaagaaagtttccaaatccacatgcttttatctgtgtacgcgataaatatattagtgcacgtggaaaaaccactccttttgtattctttacaccactgacctttgagtgttcccaacagaaagctggtcacgcttggagttcggccgactagtagttgttgtttttacggaacgtgctctcctttctggtttctccccagtctctttattggtgcgcggtaaaataacttaccgatccgcttctatttacttctgtccctgccctgcctgacctgccgggcaagttccctcgactctcccgcccacatactggaaggtgcagagcccaaggcgcacagctctcggatggaaatgggactcatgcacaaggcaatccccgctactaagcggtggcgcttctggaaggcaccctctgcctaagtgacagcagctgctgtggaacgcgcccccgggggaggacattagatcaaggtgctttggccacgccgaggcctcctccgcccccgaccgccgttcccacgctccctgtcccatggcgaaggtcgccggtgcccggtattcacctacggcattcgcggctgcagccttcagcacccgcgccattttgg

SEQ ID NO: 9587 - DNA, 931 bp, Homo sapiens
ctatatttactatgtctttttctatacatacatacttaggataaagtttaatttataaattaaatgttaatgaggctaacagtagttaataataacatagaacaattataacaatataccagcattactactcttgcacttttacattgttaagtaaaataggagttactggaacacaagcgctgtgatactgcaacaatctgataacccagacagtactgagtgactaactggtgggcgatatatacagcctggatgtgctggacaaagggatgattcaagggtgagatagagtggatggcacgagatttcatcatgctgctcagaacaatgtgcaatttaaaatttatgagttgttcatttctagaattttctatttaacattttcagactgtggttgactgtgggtaactgacaccatggaaagcaaaactgtggataaggggggactaactgtaccagtaaatgctgcctcatcacctacacccttggtttacttctcagataaactcaggaagtttaaatggcattctgagaatctgtagctgcaacatagtgagcccaggagtcccggtccagcagctagtattaaattctctgttgctagcttggacctctctcgatatctaggaattgtctgcagtgtgcggtggcacagtaacaaccatttgtttctcaacaagaatctgataatgttgcttgaacctcctgaaccagtgctgcatgctctgcttcttcatatgtttgtccttagatttgaccaaaaacaataactgataatgtaatacagattccccagctccctgtgagctgggttgagcccaggaagtctgtacaagagagcatgtctactgggatttaaatagcccagaaacaggcagccggaatttcttatactcttgtgctctaaaaaaaaaaaaaaaaaaaaaaa

SEQ ID NO: 9588 - DNA, 931 bp, Homo sapiens
ctatatttactatgtctttttctatacatacatacttaggataaagtttaatttataaattaaatgttaatgaggctaacagtagttaataataacatagaacaattataacaatataccagcattactactcttgcacttttacattgttaagtaaaataggagttacttgaacacaagcgctgtgatactgcaacaatctgataacccagacagtactgagtgactaactggtgggcgatatatacagcctggatgtgctggacaaagggatgattcaagggtgagatagagtggatggcacgagatttcatcatgctgctcagaacaatgtgcaatttaaaatttatgagttgttcatttctagaattttctatttaacattttcagactgtggttgactgtgggtaactgacaccatggaaagcaaaactgtggataaggggggactaactgtaccagtaaatgctgcctcatcacctacacccttggtttacttctcagataaactcaggaagtttaaatggcattctgagaatctgtagctgcaacatagtgagcccaggagtcccggtccagcagctagtattaaattctctgttgctagcttggacctctctcgatatctaggaattgtctgcagtgtgcggtggcacagtaacaaccatttgtttctcaacaagaatctgataatgttgcttgaacctcctgaaccagtgctgcatgctctgcttcttcatatgtttgtccttagatttgaccaaaaacaataactgataacataatacagattccccagctccctgtgagctgggttgagcccaggaagtctgtacaagagagcatgtctactgggatttaaatagcccagaaacaggcagccggaatttcttacactcttgtgctctaaaaaaaaaaaaaaaggaagaaa

SEQ ID NO: 9589 - DNA, 932 bp, Homo sapiens
ctatatttactatgtctttttctatacatacatacttaggataaagtttaatttataaattaaatgttaatgaggctaacagtagttaataataacatagaacaattataacaatataccagcattactactcttgcacttttacattgttaagtaaaataggagttactggaacacaagcgctgtgatactgcaacaatctgataacccagacagtactgagtgactaactggtgggcgatatatacagcctggatgtgctggacaaagggatgattcaagggtgagatagagtggatggcacgagatttcatcatgctgctcagaacaatgtgcaatttaaaatttatgagttgttcatttctagaattttctatttaacattttccgactgtggttgactgtgggtaactgacaccatggaaagcaaaactgtggataaggggggactaactgtaccagtaaatgctgcctcatcacctacacccttggtttacttctcagataaactcaggaagtttaaatggcattctgagaatctgtagctgcaacatagtgagcccaggagtcccggtccagcagctagtattaaattctctgttgctagcttggacctctctcgatatctaggaattgtctgcagtgtgcggtggcacagtaacaaccatttgtttctcaacaagaatctgataatgttgcttgaacctcctgaaccagtgctgcatgctctgcttcttcatatgtttgtccttagatttgaccaaaaacaataactgataatgtaatacagattccccagctccctgtgagctgggttgagcccaggaagtctgtacaagagagcatgtctactgggatttaaatagcccagaaacaggcagccggaatttcttatactcttgtgctctaaaaaaaaaaaaaaagaaaaaaaa

SEQ ID NO: 9590 - DNA, 1645 bp, Homo sapiens
atatcatcataattattttattattattatttgctatcacagagtagtgtacaactaacagaacaattatattgggtaagctgcatgaaaaacaattgaagagggaaaaataatatctccatatatatgtaattgatttgtactatgcactaataaagcctgccttaaatttctgttctagtttaaaccccgaaacagtaccaggcaaggttagtggctattgaaaatatcattaaggacagggttatctaaagacacactggatactacattaattttgcaaaaataaaaagacagtatacagtgttcagtttaaaaacaaatcatatgatcttacatttcagctttttttctttgaaatcagtggtgtaatgcggagttaaatacttttaggcaaaaaacaaacacatacacacacactcacacaaaaacaaattaataaaacaaaagcctcttttaaaaccaccctattgaccatcatcatttttttcttcacccttttcatctttctattcaccaatgtctttccagtcctttttttcttttcttcttttttctttttccagtttttccaacttcccctttccctgcatcagactttcttttatcccagaatacagcaatagcctttatatctataatcttaaaagcctttctttcctcaaggctgtatattatctgcagcagtaattcttcatttctttcatttctctcagttttcttacatcatcgccaatgaattagccaagatgttctcctgtgctcttttggtgaaattttcagaacaaaacaagaaaaaggagatccctttggtacattagaatcctggaacttctttcttctctctctttctctctctcgtttccttgtagacagaatatagatttttgtttctttcttataatgggcctgttcaccttcaccctgtcttccaattttttctttctctttagcagaaatgaatttccatcttttctgaacataaaaaaaagaagaattctaagaagttgactgaagcatctgggtgctttttcttgggctccttctggcaagttggcagaacgaaggaaagaaggcagggaaggagggagagaggagggagggaaggaaggaaggaaggaaggaaggaaggaaggaaggaaggaagggagggagggagggagggagggggaagggaggggaggggagggaaggaaggaggcaggcagagaggtgggggaaaagagaaaaaaaaaagaaagagaaaggaagaaaggaaggaagggagagagtgagaaggagagaaagaaaaagagataggaagaaaagcatgcaaaggcattttgcctcttactcccttggatctcctttccccaagtgtctagttaacttttcctcagccaggcagtcacccagtacctgttttgctcttacttgccctgacactgtctgtagcgcttaatgctttgccatgactgtcttcttatttaaaaaatagttccataataaaagttcattatttccttctgtcagccaagaaagtatgtagctttctatgttttctacctgtctgtaactccaaccctgccccaacatgaggtcctctgtgtactttgtttgacagaggctttgctttctcattctttaacaatgttacttctcaaaa

SEQ ID NO: 9591 - DNA, 226 bp, Homo sapiens
tttcaccttttggatctgctgtgatgcagaaagggcaagcagagctgcagagctcctcaaaactgtgtggggtgctctccaaaggccagccagcctgcatgttccttttcattgagagatgactggaaatatagaagtgaggggtgtcacctccattgaaagaatgggtggcagatataaggcccaaagtccttttcttttagagtttagatctaatatgacagat

SEQ ID NO: 9592 - DNA, 1500 bp, Homo sapiens
atatcatcataattattttattattattatttgctatcacagagtagtgtacaactaacagaacaattatattgggtaagctgcatgaaaaacaattgaagagggaaaaataatatctccatatatatgtaattgatttgtactatgcactaataaagcctgccttagatttctgttctagtttaaaccccgaaacagtaccaggcaaggttagtggctattgaaaatatcattaaggacagggttatctaaagacacactggatactacattaattttgcaaaaataaaaagacagtatacagtgttcagtttaaaaacaaatcatatgatcttacatttcagctttttttctttgaaatcagtggtgtaatggggagttaaatacttttaggcaaaaaacaaacacatacacacacactcacacaaaaacaaattaataaaacaaaagcctcttttaaaaccaccctattgactatcatcatttttttcttcacccttttcatctttctattcaccaatgtctttccagtcctttttttcttttcttcttttttctttttccagtttttccaacttcccctttccctgcatcagactttcttttatcccagaatacagcaatagcctttatatctataatcttaaaatcctttctttcctcaagtctgtatattatctgcagcagtaattcttcatttctttcatttctctcagttttcttacatcatcgccaatgaattagccaagatgttctcctgtgctcttttggtgaaattttcagaacaaaacaagaaaaaggagatccctttggtacattagaatcctggaacttctttcttctctctctttctttctctctctcgtttccttgtagacagaatatagatttttgtttctttcttataatgggcctgttcaccttcaccctgtcttcaaattttttctttctctttagcagaaatgaatttccatcttttctgaacataaaaaaaagaagaattctaagaagttgactgaagcatctgggtgctttttcttgggctccttctggcaagttggcagaacgaaggaaagaaggcagggaaggagggagagaggagggaggggaggaaggaaggaagggagggagggagggagggggaagggaggggaggggagggaaggaaggaggcagacagagaggtgggggaaaagagaaaaaaaaaagaaagagaaaggaagaaaggaaggaagggagagagtgagaaggagagaaagaaaaagagatcggaagaaaagcatgcaaaggcattttgcctcttactcccttggatctcctttccccaagtgtctagttaacttttcctcagccaggcagtcacccagtacctgttttgctcttacttgccctgacactgtctgtagcgcttaatgctttgccatgactgtcttcttatttaaaaaatagttccataataaaagttcattatttccttctgtcagccaagaaagtatgtag

SEQ ID NO: 9593 - DNA, 226 bp, Homo sapiens
tttcaccttttggatctgctgtgatgcagaaagggcaagcagagctgcagagctcctcaaaactgtgtggggtgctctccaaaggcgagccagcctgcatgttccttttcattgagagatgactggaaatatagaaatgaggggtgtcacctccattgaaagaatgggtggcagatataaggcccaaagtccttttcttttagagtttagatctaatatgacagat

SEQ ID NO: 9594 - DNA, 226 bp, Homo sapiens
tttcaccttttggatctgctgtgatgcagaaagggcaagcagagctgcagagctcctcaaaactgtgtggggtgctctccaaaggccagccagcctgcatgttccttttcattgagagatgactggaaatatagaaatgaggggtgtcacctccattgaaagaatgggtggcagatataaggcccaaagtccttttcttttagagtttagatctaatatgacagat

SEQ ID NO: 9595 - DNA, 1500 bp, Homo sapiens
atatcatcataattattttattattattatttgctatcacagagtagtgtacaactaacagaacaattatattgggtaagctgcatgaaaaacaattgaagagggaaaaataatatctccatatatatgtaattgatttgtactatgcactaataaagcctgccttaaatttctgttctagtttaaaccccgaaacagtaccaggcaaggttagtggctattgaaaatatcattaaggacagggttatctaaagacacactggatactacattaattttgcaaaaataaaaagacagtatacagtgttcagtttaaaaacaaatcatatgatcttacatttcagcttttttctttgaaatcagtggtgtaatgcggaggttaaatactttcaggcaaaaaacaaacacatacacacacactcacacaaaacaaaattaataaaacaaaagcctcttttaaaaccaccctattgaccatcatcatttttttcttcacccttttcatctttctattcaccaatgtctttccagtcctttttttcttttcttcttttttctttttccagtttttccaacttcccctttccctgcatcagactttcttttatcccagaatacagcaatagcctttatatctataatcttaaaagcctttctttcctcaaggctgtatattatctgcagcagtaattcttcatttctttcatttctctcagttttcttacatcatcgccaatgaattagccaagatgttctcctgtgctcttttggtgaaattttcagaacaaaacaagaaaaaggagatccctttggtacattagaatcctggaacttctttcttctctctctttctctctctcgtttccttgtagacagaatatagatttttgtttctttcttataatgggcctgttcaccttcaccctgtcttccaattttttctttctctttagcagaaatgaatttccatcttttctgaacataaaaaaaagaagaattctaagaagttgactgaagcatctgggtgctttttcttgggctccttctggcaagttggcagaacgaaggaaagaaggcagggaaggagggagagaggagggagggaaggaaggaaggaaggaaggaaggaaggaaggaaggaagggagggaggggaggggagggaaggaaggaggcaggcagagaggtgggggaaaagagaaaaaaaaaagaaagagaaaggaagaaaggaaggaagggagagagtgagaaggagagaaagaaaaagagataggaagaaaagcatgcaaaggcattttgcctcttactcccttggatctcctttccccaagtgtctagttaacttttcctcagccaggcagtcacccagtacctgttttgctcttacttgccctgacactgtctgtagcgcttaatgctttgccatgactgtcttctatttaaaaaatagttccataataaaagttcattatttccttctgtcagccaagaaagtatgtag

SEQ ID NO: 9596 - DNA, 3315 bp, Homo sapiens
ggacgcgatactaggaaacccaggtctatttgttatcagagtaaggatcaagccagatagcctgttatgtaatttctccgataaaagattttgaaagcaggtgctgtgggcatctgtatggggaatcgcactcatagaattattttcatttgtaaatatttggtatcaggccaagcaagggaaagaagctttactgtattaccatctttcctggaaaagattgatttttctctctcccttaggggatatgaggtatgatacctgcaaccaaaataagctggctgttaagtgctctctccttaactattgtccaagcaatgtacatcactcttgcctagatgagtgaccatacttttttctttgctgcttggtttttctatcactaaaaagcaaatttaggtggaagatggatgggtaagtcctttgtccttgtcaaaagaatttagaaagggtaaaggtggtgggatttgaattcttttaaacggtttattcattggaaaggcaagtgagtggcagttgactgtagaatcttgggaatttttgaaggaatttaagagctgtacttattttaaataatgaggaaacaatcagagagacttaaccagggtggcaactatggaagagtgggggtagaatccaagtctacagttctacggcactgctttgtttattttttcaatcaagcacacatgagggattgcttaataaattcaagagttttctatatagtttgggattactacagacacaggtactctagccatgtgactatttcagattagtgttcccattgctctccatcctatttttcatatctaaatgtgtcatgattttagaatctctttgtaaagaaaaccaaaaagagccatgcccaaaagaatgagcatgaaatgaagcaattcaagtatttagaatttcttcttcttttttttttttttttttcaaaattctgagttaagaaagttcattgccaacagttgaggataaatagctctattgatttaggcaaatgaatgagaagatttaaacatcatcaagactcccaaagttggtgtaataaaagttgagatgttttgctagatgctgagagaaaaggcataaataggccatttgtgctcctgtaaacaaatgaaattttgtaatgatcaagagacagcaagatattataaaacacactttggactcatcgagacctggctcagagttgtacctaatttgcttatcagcatttggttagaccttagacaaattttataacctctctaagcccattttctttatctgtaaataaaggaaaaagatctgtttggatttgggacaggagagttgtctgttttatagggtaatgtttatgaaaataatttatcacctaggtacttagtaaataccagtttctgtctctgtttttcttcaaagctttgttgacaatgtaggatattgccaactaatcctttgacttgagtgcttagccatgccccaatccaggcagcatgaagaatgatcaagaaggggacacctagtggcagttgacctttgaggatctatctaggatcaggttactgatttgggacctctgaatcagtacatcataacatcgagagtgatctctgccaaaattaaaattctgtcagaacagtataagcagaaggaagacattaggtctttctgaaatatggagctgataacttctatcagttctgaattctgtactgtcccacccccaaatcatctatattgttgcatgtgcttagctttgtgccttgaattgctatttcctttttatcttgcactcagatggtatttttagagatgtttcttcaatcaaaacaagataaagttaaaaaaaaaaaaaaaacagtgacccttttgcataagccagaagagcagtgccttgcttcctgtgaaaaatgcttggcagttagcctgtgtaattatttagcaatcatgttaatagatgtttaagaataatggaactggagctgtactgagccaaggatggaaatgaagacatgtgagactattttttcttcatccaccgatactcttcagttacaaggatttaatttaaaagggttttaattaaatggaatccagaagctttggacgctccagtttttcttcttagagacaaaccctagctcagtttcctggagcttgactcagaatgcagcatggtactccggactgacagtgtgccagctttattcacttatctctctaccttttggcttgcgtttatttcagggctgcctgacattttgaccttatgtacaaagatggccgatacgattatttttcatcatatattacagaaaatactactcttgaaaaatactctgagaaatatgttctatggtcagataagtttgggaaacagtgaattattgttcctcctttgcagaatcacaatgcactgttagctaattaaagactctcagatgtcccactggaaagaatcatgtttagctttgtttaacctagcatttcccaaacttattagagcataaaactttgtttttgtttttttttaataagataggtagctatttccttagaacacagtttgggaaactttttgttcatttgttttaataagataccttaggtagctatttccttagaacacgagccgggtgcagtggctcacgcctgtaatcccagcactttgggaggcccaggcgggcggatcacctgaggtcaggagatcgagatcatccggcccaacatggtgaaaccccgtctctactaaaaagacaaaaattagccagccatggtggcaggcacctgtagtcctagctactgtggaggctgaggcaggagaatcacttgaacccgggatggggaggttgcagtgagctgagatggcgccactgtactccagcctgggcgacgagcaaaaactccttcaaaaaaaaaaaaaaaacataacttaggtagctatttccttgggaaccaatatctttacattggctagaactgtgaatcgccctttaaagataaagccccaaaatacattttttttccctacaggtaaccagagggtgaagtaacagccgaagaggaaaccagaagtgaagtgatttgtacaaaatgtcgtagtgtaatttattgagtgtcatgtggtattaatcgcaacatcctgaaaatgcaaatgaataaaagtttggtcaatgtaccatgacattccttcatgtgagcctcctaagaaaaggtcactgagcattctctgtttacattttaattttagactccagaatttcacactaagtttttcttctcatttcttatgcagtaaaagaagagtttgtatttcca

SEQ ID NO: 9597 - DNA, 20449 bp, Homo sapiens
agattctggagatagaaacttttatccctcttcttctacaggtaagaaatataagatctgaggcaaagaaaatagagttctaagaatgctgaggacagcatcagaaagttgtacagtttgggtgtgctgattgccatagttatgtattttccttaacttcattatgtttggtattctattttaagcctgtaaactttcttgaatctattcactggctatttagtagttgttttgcttcgagaagtactatttaaaatttcatagtctatttctgtagttttgaaaagatttagtaattttaatcaagaaaattacattgttgtgcagtttggtgggaagatgagctgtttcttcatttcttttgttataattgtttgtagaattatttttttcattttcactgagtgcattgcttttctttatgcctaagtttttgagctaaattgtgctatttaagaatttttttactgtaaaatattctttactattgaagcattaaaaacaaaatgtggaattcccaacttaaggatagagaccactctaatatgcagataaattgagttccagaagttgtttttataagtgaagctacttggaacttggaatgtattctatcaggatatgtttcaaggaactaggagacatatagagtaggaaattgaagtagtagtgtagataattaaagaaggtagtttttactgctttggtgggttcagaattggtcctcagctaattgtgaaacatgtttatttcgcatctttccatttctcttcttgggcttctgtttctttctgtgtgctcgttacctaatgcctgacctaatccttccagccttctttggattaccctgcctattaaagtagggtaattccatgcttgccttctaaatacctccattctccctcacccactgtcacccaggagcaataacgtccataattggttcacaaattgttctgtaaatttgctagactcctgtttgtggagctggtaaagtttggtaatttgtaagataaggaagctgtttgatgaagactgagtctctcgggtaataaattggagacaagaggataatagagtattttgccatttccttacttttcatttctagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaaggtaaaagagacaggaaaaaaaatcattcccatttaaggacatttgttccatgatccaagtatttgtgaatagcttttgtgtagactattagcattcttggctatccaggaacttggctatccataaatccaaaagcacttttgtcgacttctgcaagagatgtgaatggaccaaataatttatttccttcatttcattcattaatattaatttaagtaacttataatctaaaggcttcttttcattgtcccttctcctttcttcatgtccccaaaagatatacagttaatataattttaaaatctaaaaataaagtgaacaagaggagaacacaccaattcttacttcataaaggatgcaggccccatctcatagttacccccaaatgtcctcaatttttagtcttccttgattttttaatttaagggataaagatagcattgacctcagagagcgtaatagaactctcatttttgtagtaccttcagtcttctgacccttggttacttgaagtagggaagctaaggttgaaagagcattattgcttaaaagatgagccaaaatggctaacatgaaaatttaaaagaagcacagaaacagaaacctccttatgtatattaaaagagattttacactgctaatattttctgtttgtgggggaatttgtctttggaaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcaggtaagaaaaaataggaagcttataagtttattttgcatttgctggctgacatatgcctaaatcagtgatacttaaccatttggccgttgagaaaaggaaagttggaaccccaccttacacatagcatatgaaaaatcgatttcagattgattaaaaatacatgcactaaagaaactaaacaaactagaaactactagaagaaaatattaatgaatatacagtgttggagtgagaaaggtcttcctaagcttgttacaaaagcagaaatcataaagaaaaatagcgattggagaaaagatttattttcagtatttaaaatttatttcaatatttaacaaacaagttgaattctgaatatatttatagaactcataaattgttttaaaaaatcaagactaacaggaaaatatgaatatgcaattcatattttataacaagtataaatcactgaattacattttcacttctataacaatgctcagtgttgggataggtttggggaaactttattctcatacaatgctagtaggaaaataatttggtggacaaattgtcagcatgtatgaaaagcaatgttctcacatctaggaatttatcctaaaaaaataattgggcaagtttggaaagacttgtatgcttcatgttcatcactgcaaattattctggaaatgagaaacaacccaaatatctgtcagtagggattaattgcattattacatattccatataaaagaaatactagatagccactaagaatgataacattgtatttactaacaggaagaatgtttatgctatattaagtggaaaaaagttgcaaagtatatctacagtatctcattttaaaaaggagctgcaatacatacatatagaaatacatacagataatctatacaaaatgacctggcagcatatacatcaaaatatagtctttggttggtagcatttggggttattttaatttttttctttttttctctctctctttacagcaaaatatccaatataggttgttatacaaattagagatcttgagttattcatgaaaaagcatcatttatcatcagcttaaatgtgtatgcatagatgtaactcatgcagatcttattgtccctccaaatatttggttatattaaatcaagttactctatttgtgtacttaatgcctgagaacagatgtgacctttaaatgataactttaaaaatattagaacctagttcaaatcagtgatgtttcctaatagccaccttagaaattaattattctatcagtaatcaactgatgttttcattacatattggttttttggaatttcttctttgagtcagtttcattgcctgagtcatactgtagtattgattgaaacatttttatccagattggttacctgtttttcttattcattaagcctaactctagatgagtttttagcgattcaagaaataaatatattttcagatgatgatttgccactattaaatatatttctggagagttgaaaacactgtcccccaaaataagaatactatgcatttaagtgataacatttgaagaattagtgtcgagagggaaagactaggtggataaatgaataaaagtcactaatttgaaggggacttgactcatttggagcgagttctaaaatgtttggtcacaatacagttcatgttgttttattgttaatgcttcatgtctaacctttgggcaaagtaccaaattgggcagtgttaaagaactagaaaacttaaatgaacttgtaactcaagctgtgcgtcacaaagaaccagaatataaatgatatttttagaagtcttccagtaatctttcggttgcctttgcatgaaatccagcttcctttttttttttttttaaatattgtgtttatattcttattttactttcttctttcatctagtactttggatttagtctctactgaactggaccaaagagctttgtgtgtggttcctcacctttaagttgaataagccttagttttaagctcctttctagtctgtaatttaacagtaaaccagactgaccaatttgcggtcacatcctcatcccacctaaagtgatctagtagaagtgacaaccattacgcagagaacagaaacaaagcatacaaaaaacattaagaaacatgaggaaggaggaaaagcactgtgcaaaaattgagtcaattataatactgctaggtgtatttgctattaaactgggtattgtattggcttcttagttactttgttcctttatagttttgtgtctgtgtaactacagttgtggcacattgtatagaattttttttttttttttttttggagatgagatctcactttgtcaccaggctggagtgcagaggcacgattgaagctcgccacaacctctgcctcccaagcttaagcgatccccccacctcagtctccagagtagctgagactataggcatgcaccaccatgcccagctaatttttgtatttttagtagagacagggtttcaccatgttgtccaggctggtctcaaactcctggactcaagtgatctgtctgccttggcctccccaagtgctgggattacagatgtgagctaccatgcctggccagaatagtattaatctatattgtgattgttatggtcttaggaatattaagcctttaagttggtaagttttattttaggattgttccatgtattgcaaattaaaagtttgtatttatcactgttaatgtagcataaaattatccctcagttttatgaaaggtactcacttatccaagttactaagtcttcacttcttgcagtgtgcaaagtgaacaagttttgcttatctagatgagatattttctctataaaattgaaacaaaagcaaatgaatgcacagtctgattatgtttgcattacagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtacttttataattataatatgttctcttattcatcattttggcaagatggaaaggtttatattgttctgctttgcctctttgctatctctttttaagatatttgagaaaatgaaataatgggaactataaataactctctgacagtcttgctggtttgatgtgactttctatctcagctaccacataaaagatatttattgatggtaaaagaaatgtttctgaaactttttgttcataaaatgatatataacaaaattacattataatatgtgtactgttacaaggagtatgttttgctttgcaggggtataatttagactgctttttattgtgtatagggggaggttgtcttgggaataagggaagattgtaaaatgtattcagaccttgggattttaaaaatatatatattttttatgtaatcaaaaatgcataatatcaaataaaatgatgattctttcattaatgaagggtagaatacattagaaaaaacataaagataatactaatgataaaattaggactttggctatgaacatggctatgtaaaagctcaccttttttggaaattatgcaaatgtaacaggaaaatgagaaaaagaggggacaaactatttttatagactatctgtgcagtagcagaagaaaagagggccttttgttatgaaaaccgtccagccttcagaaaacagccttgctcaccccatcttcatgtctcccacatagctaatctaagaaacttacttattcagtgatgaatagtataaagggaactagcacaagctcaatttataggaaaaaatgaagaacagcaaaacatagataggatacatgctccagaaaccatgttggcctggaaaagatgaaattttcaaatatacattttgctgtaaattgggaaatacttaatgaagtaaccatatctttgaggaaaagctacaaagcagagaaatgtaagaactcagaaagagatgaaatgtaagctggaagaaaataaaatcagaggaatgaaaacaaaatcaaaaggaatacagggaagaatagacactgcacagaatacttcataaggaatagagtgaaactgagaaactaataattttgcaagtttagaaatagaaggacctcaatatttgagtccttttacagaaaatcttactcaaataataaggaaagttactttctctcataacaagatggaaatagggtggttccaaggttgggttacagggtagctcaacgatgttattctgccctgctaatgtcagcatgtgagcccagttctccacatggtcagagtggcaacagaattcccaggtataatatccacacataacaacaaaggacgtatatccagaatatatgaactcctataaaagttattactaaataaggcagaccaatacaaaatgggcaaatgacttgaacagacacttcacataaggaagacctacaggtagccaatacgtcatgaaaaagtgcttaccatcattagttgtcaaggaaatagaaattaaagctacaatgatataccactacctacccaaaagaatgggtaaaatgatgaagattgacattatgacaaatgttggcaaggatgtacaacaactgaaactctagaactggggttctagagtttacacattgctggggaatgtgtaaagtgggataacaattttggaaaagtttgacagtttcttataaagtatgcacttactgtacagctcagcaatttcactcctgcatatttattcaagagcaatgaaaacatgtccacaaaaatatttgtacatgaatatttattgcagctttatgcaagatagcttcaaactagaaacaggccaacttttcatgaaaaggtgagtggacaaaactgtggtatatttgttcagtgaaagaatactcaaaaaggtatgaatttctcatgtacacatacatgaatatatctcagaaacatgctgattgaaagaaacaggacacaaaagaatatatccttttgatgctatttttatgtaattctagaactggcaaaaaataatctgtagtgacagaaagtaaatcagtggttgcctggggctgggggatgcagatttgaccaaaatggggcctgagatgatggacatttttattgtggtggtggtcacatgggaaaatgtattgtcaaaattcatcaaattgtacacttgaacacattttattgtgtataaactatacctccatgtagttgacttaaaaagtgttttgtaaacttcctaaagatagagagactataaattacagtatctgcagggtaagcaataaactttttgtcaaattgatgaaaagataaatgtctgagttgccagtattagtgactgaaacctttctgaacttccctatttgtacatacactttttttctttctttcttcttcttttttttttaaacagggccttactctgttacccaggccggagtgtagtgtcatgatctcaactcactgcaacctccacctcctgggctcaagcaatcctcccaacatagccttctgagtagctggaactacaggcacgcgccaccatgcccagctaatttttgtataatttgtagagatgggatttcaccgcattgcccaggctggtctttaactcctgggctcaagcgatctgcccatgttggcctcccatgtacatatattttcaaactgaacagaaagtgcaatgaagattatttgtttttttctttgatggaggaatgctgtagacatttactagtgatacgttaagtaataaataagcatactaagttatattgctgagcatcaaactgggataccagttaataagctagacatagtctctgctttcatgaagttttgcaatctaatgggggaagactgttaattccaaaaatagttatttagttatcagcaaaggtaaagacaagtgctgtaagtgttaataacataaggatgtagtttgatctgattagtatggtttctttaataatgttcattaacttgttcttggaattccaagcctatgattatgtttcttttgggattgattaaggataagatgtttgttcctagcacattatttaaatgatctctagtgtcttttggcttttgcaaatgcaccatattttccattttttatttctaggtgacaactgttgatagatttcaaggtcaacagaatgactatattcttctttctctggtacgaaccagggcagtgggccatctgaggtacgtaggaaaaaactttcataatatttattgaactttactatctacttcaattttgaaattctgtggctaagtgttctaaatattttttaagtttaaactataattactaggcaacttttgctgctttttgttggaatgtaacatcaaattccttgtaactattctcattgctgctggatttttttactcttaaatgttttagtaattttaagttttaccctttagtaaccctcagagatagcgttttatcataaaatcttaatctctcctgtatctgttagaaacttaatatcagaaattaaaggagattaactaaaaagtcttcagaataaattttcattgtataatatgttttctcattttttctcatacacaatctttcagcctcagtgttagaggataaaggagccatttgttctccctggattaagaattgtcaaaacaaacaatctacttttatcgtttattatgatgtatttatgtgctagagatttacggaaataatatcttcttattataaagcatccatttagttttatataaaccttcatctcatatgacatactaacaaaactaaggagagtttattttattactttattgattagaaataaaaagaaaattctccaagctctcataatgttgtcattaagatctgtttggagcttaacccagtgatcaggtttcatgagattaataacttttatgtaaaggtaagtaaagatgtaatgttttaaaaaattgttttgcatactagaagtttgtttttgcatattaagtgtcaagccaatatttacagacttaactttttacaaaagcaattccttcttctcattgagatttataactgccatctgaatggactgtcactatggtttatataattaacatctcaaaaacttacagtatgaatatatgaatactccttccgcccccctcctctccctaccttttttcttaactctgtggtacttggtcttcaaattccagtgactttagttctgtgctgccctttgcctaatttttctgtaaacttagaaaacaagaaagattttgatgatacaatgcttataaatgaagggttaaaagaaaacctgatttcagtattgtcttgaacatcaaaattttttagcaaaaatacctttatcccaataacttaaatttatttgtatttgccaaaattttcctttgaaactccaacttcttcatgggggatagtgttggtggtggttgtgcatagaagggatatgtcagttcattatttatgattccagttacccaggtagcttagcctaggtatcttagctagaattttatcaaacttttaataagaatttctgatttttagaaagctaatctttcatatccttccttttatatataggcaaggaactatttctgtttcaggataccaaggaaacctacttcctgccatatttcatttttttgataacattattgagttgtaatttgcgtatacaatttatctatttaaagtgtacaattcaatgatttttttgtatattaacagctatgcagttatctccacaatcaattttagaacattttcatcactgtagcaggaaaccctgtacttagcaatcacttccctccccactcccccaaacccttggcaaccactaatttactttttatctctgtagatttgcctattttggacacttaatataaatggaatcatataatatgtggtcttttgttactggcttctctcacttaacatatgttcaaggttcattgttgtcgaatgtatcagtacttcattccttttcattgctgaatagtattccattgtgtggctatgtcacattttatttatccattcatcaattggacattgggttgtttccactttgtggctattagaatgaataatgctgctatgaatatgcatatacaatttttatgtgaacacttgtttttctttcacttggatgtagacctaagagtagaatttctgggtcatatggtaactctgtatttagcattttagggaactgttagactgttttccaagtgcctgccttatttcttttgctcacacctttttttcagccagggtggactaattgggtgattgggttggagccagcttcagttccagaggcctgttttaggacaatgtggagctgtttagtagccagagtagtgggacagttctggtcccttttccagcattcattgttcttgtaccgaactgatttggacagcctagctaccaatagaaatgcacgtaacctgttctgagccaagtaatgaggctgcagctttcctctgttgtttcctcataggggttctatcagagtgttggcgttgttgtttaacagtgcttttcctctccagccatcttctggggactaagaaagaatgttgtagcccatattgccctgctttcaagacataactccaaggaactctgcctactcatgttaccatcctttgttttttttgcctggtagtttgttatgttcgtagtatttggtcattcatttaacaaacattttcagatccatccattgtttgtcagtgtgctagattcttaatatttagtaatagatctaacattcatgatctctgcccttgtggactttagggtctagtggcagattcattaatatatccttggaagatacctacatttgaatctgcagaaaatttgtagttcaaatctcctcatgtacaacggagatcatactgacaaaagccactttactgcactatagcactgaaggctggggagaagttttctccgagaccatacagtggtcattgcaataatgctgtatctgtgctgctctgtctagagatagggccttctggatgtaagagatcaccatgaaaacaacagtttatcacctgcttccaccactaaccctttttcctcctaacaacattaaattccactataattttatttataatatttgtgtgaggacttacgctaggtatttctagcagtgtaccttcagttaccagtgttggaaccacccaactgtagcataaccccttggggttttaaggaaatgtggcgaaaataataatttggctgacagtaacttagaaaataatatttccttcatgaatccagtatgtcacaaatgtagagattcctcaaggtttctgtaaaggagtatgtcctttccttctacctaaatgagcatgtcttaattttgtttgttgctggggaaagggtacctatccctgctctgtcccttcacacacatacacgtagcacaagaatataagtgatagcatatgctggtgtcacactgtacctccttaaggaaactagatgattttaagaccatagactagaccataaaaaaaaccataaaaaatgaggccgaattagagatactccccaaataccttgcattacacaaagaaaagctattagataaatattccaattcctggttctctctgtctctctgaatgttacagagaacaatctctgtaacattagatctctgtaacactcttcacactttctttcagagattggaggtgattctcccaggctttattattcttcatgaaagtcttctcttttgcagagtactcaaaaatttaaatagccatctaaaaacatctcaggtaaaaaatctgtcctctgcatttgaaaccaaaattattttttctcactaaaacacattttatttaatagtgaggtgaaattacattagccctcttcacatttatttgattcaaaccttttttaaaaaacttagattcttttaaaaaaataaattaaagaaaaatgacatcattcatcagatagccagctacatgtgtagtttgatcattcagtttaaccgttttatcactgttgatatgaacattgagtacctattataggccaggcattgaatctaaatactagaataaatacatggataaaacatgttataggctgactgtcccttatctgaagtttcagattttgaactttcacattagggatgctcaacttgtgttgttttataacatcatactgtatttccatatgtacttattattgtaaataagtataaaacagtgtggtaagagttatctaggaagtaaaattttaccttaatggagcctgggattttggtaggtgaagtggaagaagagctagttcgaattgactcaatgacagtgatacagtaagttagtaactgacaattgaactctactgtaatactaatatattacttagacctttttaataagtgcattggttattttgtgatcctccccttcaaaaaaccaacaagaggttagtaataaagccttaacttttacttggtttattagtcacgtaacattgattaacttctattaagtttttaagaagcttaactttttattgccagggcttaacaggactatctaatgaaatctgtgaaaaaaaaaaaagctgcttaaatgttaataatcttgaagtgtgctaattattttgtttatttcccaaagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaaggtaggacttctttcttcattttataaaacagcattcctcagagtggaaattgggattttcttataggtgaccacattagcttggaacattattatagataatttagtccctgttttagagtgtgctgcactgaggaactgaggtagattttctatataaaaatgatatcggtagggcgcagtggcttatgcctgtaatcccagcactttgggaggctgaggtaggaggattgcttgagcccaggagtttgagaccagcctgggcaacatagtgagaccttgtctctataaaaaataaataaataaaaattaaaaataataatgtcagccaacatttagtggctaccatgtattaggcaggcagttctttacatacattatctcattttcatctcagtaaaaacagcctattaggttattagattattttattaaccccgttttacaaatggagaaacttagggtcagagaagctaagtagtttggccatgcatctagcagatagaggatccaagatctgaaaagccaggaggtcttttcgaataacatcccagagttcatgttatttatcattatactgtactgtttgtcttcagctttgtaaggagaacttaactacttacttggaaatagagcaataaatagttgagttcttaagaagcttacattctggggaaatgagggaggagagagcacatatatttaaagaaaagatagagaaatactactccctcttatctccccttctttctccccttttcctagcaccttccctccataggtaaccagtttctttagtttcacgtttatccttatattccttttgtataaaggagaagagatatgttacttttatattattttccttcaggttattatactatagacttttgggctttgctttttcatttaatgaattgtcctaggggggtccattggattttaaataacattattttagatgttcacagtatacgtcttccctccacccctactaaaaaaaaacttaaatcttgtgtgtttaataataataagtactttataaaaagtgcctttttatttacttatttttgaagaaatgctgctgtggagaaataggaaaatggtggagagagatcatggggtggtagggtcacataaagcctcaagtgtcaggctcaagtctagacacaatcctattatatccgagtttcttgatcttttgtgggctagtaaacaggcacattcctgacaagaggtctgggacagagcctaggtgtcatcatgtgtaacaagctccccacgtgctttctatgtaagggctacatgtcacacctgaagaaatctggagtgcaggtcagacaatatcactgaacagaaggcttggaaacccatgctttagataacactcatgagttcaaggccctggggaggttagggctgagaacatctccccatcttctcctcaagagatagtgaggggcggagagtgctgtgtctcaaggaaaggcagctcttggcaagactccagaaaataagctaacaagcaaaaactcttccatgttcctagtcataatagcatggccgtatttgtacatacgagttctgaccattgcagaaaatgaccattaatcaaaagaatacctgcttagatggaatgctgccatcctgcttacttctgagaaatgttgtttaatttactaaattatttctaacttcatgctctttaaataacttttcactttgagattgaatcctccttttttggggtatgttttttaccttaatgattttctaaattgttcctatcataagaaaggataagactttataagcattttattaataactataaataggaaagttgttaatctctattttagggtggtttaaaaagaagtgcaaattctgtattttcttgatttgctttactaccttacctacacttatagagcagtgtttcttagattgttgtcagaagctacagaagaatcagctcattccacccagaccttctgaatctgaatctatagggctggagcctaggtacctgcaatttaacagtctaccccagatgattctgatagacaccaaaatcttaaaaagagcatttgaatattcaccctcttgactcatagtatatgtgttaaataaaagtaaatgttagcctcttactttttagaaaaatataagtaggacaaagagtgttaatattttctttctgaattatcttaagaactgtctttggagcatacacagtcttagaaactgctgtttcagactgtgttgacttttctctctagtcaaataattacttatcttgtactaattcttttatattagatagtaaactaaaacccatacttaacttaccagcccaaaattatattaaaagctggcaactcttagctcttctagtctctaacctttctaaatttcaatggaatcactattcttcatgaagtctttttttttttttaatgggagtcacgtggccagcaggcagagcgtgctgacctgggccccctttttattaattctatttaagtctttttttaacattcatgaagtcttcattggactcttcacacttgcattttatgtcctcttactgttaggtcttccagaccctaattgtgcttattcataagattaagaaatgggtttatgttgaagtgttaccttctagggttgttttactagatacttaacgttcttttttccttcttctagaatggagagagaccatctcatgaagtacaaataataaaaaatatgccccagatggcaaactttgtatacaacatgtacatgcatttgatacagactacacatcattatcatcaggtgagtttctcaaaatcgacttttatttttcttgctgtagaaataattttctttttttcagaataaatctttaaagtacctaattccttgtgggaaatcagctaaactaaagcaggctattattatttatgtaacattcgtatttttaaaacttctttatatagttagaattccacatacaataaagtccacaaacttaaagtgtaaaattttatatgttctggcataggtatttacctgtgaagccatcagcacagtcaagataaagagcatatccattatcccaagagttttcccttgtgcccatttgtaatccctccttgcccttcaccagtcccctttttaccttcccaggcagccaaggatctgctttctgtcatgataggtttgcttctattttctagatttttatataaatggaagcatacagtatgtattcttattttttctggctactattgcttatacaagtctttgtactttatcttgggtagatacctaagagtggaatggctgaatttatgttaaggatgtgtttaactttttaagaagctaccaacctgtttttcaaagtggttgaaccactttacactctcagcagcagtgtgagagttctagttgctacacatcctcaccctcacttgatatggtacgtctttttaaaattttggcagttctaatagatatacagtggtctcagtatggttttggttttcatttccctaaggactgatgatgagcatcttttcatgtggtcatttgccatctgtatatctttggggatgtgtctgctcaggtttcctgctcatttttttattaggctgtatattttattaagttttgagaggtttttatttattctggctacaagtcctttatctgatatgtattttacaaatattttctcccattctggcttgtttatttattttgtaagtgtctttcaaagagcaaaagttttaaattttgatgaagttcaatgtatcaaagtgttcttttatgattcatgctttttatgtcctaaaaatacatagcctaactcagaggtataaaggttttttctagaagttgcagagttttaggttggatacttaggtatgatgcattttgagttaatttttatatgatacaggtaggactgagttttattcatttgtctgtggatatgcagttgtttgagcaccacttccctaataggcgatttttttctttgttgacttgcttgtcatcttagtcaaaatatcaattgactatatatgtgagagtctgggctttctattctgttccattattctgtatatccgtccctttgccatgactgtactaccttgattatagtagctttacagtcagtctggaaattagataacataagtcctttagctttgttcttcattttagaaattgtcttagctatcccagttcctttgcttttctgtatacattttacaatcagcaggtcagtttctacccccaaaagcatgctgcagtttttaaaaggatattttgaagaggaggattgtttaggatctatttggggagattaacatcttcacatattaagtcttcctatccatgaataagatctctcgtttatttagatcttctttaaattctcatcaggattttgtagttttcaacatacaaaccttacacatattttgttaacattttgctaagtatttttctttttcgttttctttttttttttttttttttttgctgctgtcgtgcacggtactttttaaaaatcttaaaggccaggcgcggtggcttatgcctgtaatcctagcactttgggaggctgaggtaggtggatcacctgcggtcaggagttcgagaccagcctggccaacatggtgaaaccccgtctctactaaaaatacaaaaattagccaggcatggtggtacatgtctgtaatcccagctacttgggaggctgaggcaggagaatcgcttgaacctgggagacggaggttgcagtgagccaagatggcaccactgcactccagcttgggcgacagagtgggactctgtctcagtcaatcaatcaatcgatcaatcaattcattcattcaatttccagcattgtaagcagagtccctgatgagaaagtcactagactgccatggggcaaagggcaagctaagcatatagagttgctccagttttctggttgaacggaacagaaaccttgttccttgctgctcccttctcccatggctttgccttaaggccaggctcctctctgcctctcacagggctctttttcttttctttttctttttcttgagacagaatctctctctgtcacccaggctggagtgcagtgacacaatctcaactcactgcaacctccaactcacagggtcaagtgattctcctgcctcagcatcctgagtagatgggattacagctcctgccaccacgctcagctaatttttgtgttttttagtagagatggggtttcaccatgttggccaggctagtctcgaactcctggcctcaagtgatccgcctgccttggcctcccaaagtgccgggaatgccaccatgagccaccgcacccagctcacagggctctttgattaaagttgaccctttcttgagttagttttataatcagtcctgatcagtcactgttttttgcagaaatgttgacagcaaagtatgttgcttaaaaatctaatagcttttcatggttgttttcctctctgaagattttatatgtattttgattatcagtatatgacatctgtgtaggcatattccttggtgttagcagaacctagaccattgtcatcagaggtgttacatctggagtataaaatggtcagcactgttttggagaactctagaatggtaatgtgagagcttagctttataagctgtttttcatattggtattgtctttgtttttttttttttaattagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccggaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagcaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacaaggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaat

SEQ ID NO: 9598 - DNA, 7905 bp, Homo sapiens
cctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggtgagtgcccgcagctgcgcctgggcgtatgcctttcctggaggcggggacgatccgggtaggagacaaagggcgagctccccttcctccaggctcatgatggtgttgctaaggaatcacagacacctaaggtgagttctgggcgggacttggtcatcttgtcagtggcccttatatgtcacctgggagactcacctggggggtgaggcgagggaaagcgcggattattgagtttgatgcccagaatcagatcaacccatagtctcacagatacataaacagtccagaagcacacaacccactgaccactcaaaaatgagaggaaaaggccaggtgcggtggctcacgcctgtaatctcagcattttgggaggccgaggcgggcgaatcatgaggtcaggagatcaagaccatcctggctaacacggtgaaaccccgtctctactaaaaatacaaacaattagcggggcatggtggtgggcgcctgtagtcccagctactcgggaggctgaggcaggagaatggctgagcccaggaggcggagcttgcagtgagccaagatcgtgccactgcactccagcctgggcgacagagtgagactccgtctcaaaaaaaaaaaaaaaaaaaggtttcccccagcagttaactttttgagtctcggttaccatttctccaaaatggaaataaaggtcctcacctttaaggaagtttgtgagtccaaatgagaaaaaaaggttggaatgtcagtagtcaggtggtgcagggtggtgtctggttgggggactcgggggaatccctgagcaggcagccttgggggaagtggggctgcagagttctgggcctgccttttctcgggggcacagggtttgaaaggactggggggatgtgcattgagttaagaaaagaagggaggaagattctttattggaagacttctcagagcctttaatatgcactttgattaaggagacggtgatggtggttttggtgtagagtttttccatactaatttgaccggaaatcttttcacaaagtgtctcctggtacctttgtaccccagagtgagcaggtattcatgctttccaagtgccggtctttgaaccagctctgtgagactgagctggtttcgttagatttacctggaggacctattaaagtgcagattcttggaccccccctccagagattttaattcggtagaccttggacaggttctggacatctgaattgtttttctttagtaagtatgcttacccaagtttggagacccctgggcctcacagcccctagcctagacctcagcccaggaggcttgatagataagataatgtgtgtagatgagtgagcatgaggtagttactctatgagattggcgtactgtgtataggcacatgtgagtaactgaatacacatatgttaatgcatgtaatgctgttggcttgtgagagcatgagaaatcatataaaaaacattggggacttccacctctgcaaagagaccaaatgaagatggagtgaaacataaataaaaaggaaatgaaaagcctgggtgcggtggctcacatctgtaatcccagcacttagagaggccgaggcagatgtattgcttgaggccagcagttcaagaccagcctggccaatgtggcaaatccccatttctactaaaatacaaaaaaatttagctgggtgtggtggtgcacgcctgtaagcccagctactcgggaggttgaggcaggagaatcacttgaacctgggaggcagaggctgcagtgacctgagatagtggcactgcattccagcttgggcaacagtgagattccatctcaagaaaagaaagagagagagagaaagaaagagaaagagaaaaatcaagcaagcaggcaagatgaatcaggcttgggtgagaattcaagatggaataaaaagaaattaggctgggatgcaaaaaaataaaaaataaaaaatagtcaagctgatttcattgaccaggatatactactcctcagggcaaggaaattacataagagtaaggtactttcttccctcagcaccatctaataatagctaagcagctttccagtaaggcttctgttgcccaaagaggtttactagactggagcaaaggggaggcttaaaaaaatccagatttctctctcccaagaggaggataggccaaggtgggtgttgaagaagaaccacccagaattcaatatacattcaacaaagtgctcctgatctgtttggaaaattgggcatcacaaccagcaaattggtgtttgaagatcctgactgacttcaaaagaataactaaccagtggcaatgtatgaagggtcattattaaccttatagaggaatgcttggctttgtggctagcctaagtatactaaaaatagaaggttatttccttcactcatgtgtatcacaaaacatacagccagttccatacttattggtgaaacatcagaaatattctcatgaaagtcaggaatataatagagatggcttacagatgttgttctgaaaattctggccaatgcaacaaggcaagaaaagtaaataggagttgtgaattcctgaaagaaggagatgataattaacttggaaaaatattaacacagtaagagaaaccctgtgggcatctattgaatattcttagaaataataacacaactaaatgaattagaataactacagataaaaaagatctcattgggcacttaggtgtgtgcagggcattatgttaggatttgtaggagagtcacaggtgaatactatttcctgttctaagaaagctcatgggctgggcgcggcggctcacacctgtaatctcagcactttgggaggctgaggcgggtggatcacaaggtcaggagatcgagaccaccctggttaacatgatgaaaccccgtttctactaaaaatacaaaaaaaattagctgggcctggtggcaggcgcctgtagtcccagctactcaggaggctgaggtaggagaatggtgtgaacccgggaggtggagcttgcagtgagctgagattgcgccactgcactccagcctgggcgacagagcaagactccgtctcaaaaaaaaaaaaaaaagaaagctcatggtttcactggagaaacaaaactggagtcctgggcacagaacaaatattaccccagcctttgtggttgtgtagttgtatgtctgtagtgcatgtgtgtgtgtacttgagggagtaatgtggtctgggggtagtcagggcggcccagaggaaggagtttgaggacagctgtcagaggctccctggacagccagctctttgaagtcaggggctgtctctagctttctgtctgcacggggcctgatgcctggtaggtccttggtaaggatttgttgaagggaggagagaaggaaggagggaaagagggaggcgaggattgttaaaaaggagaggaaggccgggcgcagcggctcaccccagcaatcccagcactttgggagccgaggctggcagatcacgaggtgaggagatggagaccatcttggccaacatggtgaaaccccgtctctattaaaaatattaaaaaattagctgggtgtggtggcatgtgcctatgatcccaactactcaggaggctgaggcaggagaatctcttgaacctgggatgtggagattgtagtgagccgaggtcgtgccactgcactccagcctggcgacagcgagactccgtctgaaaaaaaaaaaaaaaaaaaggagaggaagtgagtgacggaaggaggaaggaggggaggagagaatctatgatcagaacaaggtgggaaaaagtgaaggcactgcagaggtgccatgcagaaaaggtgggtgatatctggggacagtggtgaagagctcagggctccgaacaggagggtgaggttgcggggcaggggagatggtaatatacatgctccggcccaggaagctttgcagaaagcatacatggggaggggcggaggtaggtgccaggcaggggcctagtttggagctgctgttttaacaagaagaaagcaggatatgaccctccagttcataggtgagaacagaggccaggctgggtgctgtctggggtcaaagtctttagctgattagctatactccacggcggtaatatcaaatgatccccgcgccagcctgcaaaatcccgctcttggccctgtggctgggctgtgtggtcaggcctgggaacccactgtgagggacagagctttctccagtttggcctgggcaggcagctagtgtgtccttccctccctcccctttcacaggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtggtaagtaggctggctcctctgttccttggtgaccatgtgggactgcagcaaggatgcagcctttgtgtccggggctgggagtggagaggagctggagttgggctcagtaaacccttgttggggggtgatttctggggtcatcccctcctgtcccctagctgggcagtgccaaagggtagctcaggagggacctaccttaaaagattctggaccctttccttcctccatcttgccttcttttctctcactgcctcctagccactctgtcccctcatctggggttggagtgggtcagaagtggggctgctcagagctcagcctcttcccttgtgccctggaagttgggttgtcagggtgaacaggcagatcctgataaatggagggggacacaagaggccggggagctctcttcccgtgaatccagcgccgggttgggccatgtctcctcctgactggtgcccccttgtcctcagggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga

SEQ ID NO: 9599 - DNA, 708 bp, Homo sapiens
gaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtacca

SEQ ID NO: 9600 - DNA, 2018 bp, Homo sapiens
gtctcaggcaaggagggggcagaggcaaatcaccgggcagagggtaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga

SEQ ID NO: 9601 - DNA, 503 bp, Homo sapiens
atgtacgcaaagagggtgtctgtgtgtttgctggggggtggttgctccctggctttccaggatgttaggccttcgtcagtgcactcgacagacggttactgtttgtcaacagaatgcttggcgctgttctagctgctagggataagacggaaggagcccaggagttaaatttttgaaaattttaaattatgaggaatacaagtttactgtagaaaatgaggaagtacacatatgcatatagcaagcacctgtgagcatttggaagcatccacatggtttcagtttcggtgcttccccccacctattcctctgcttaaacagatgtcctgcaagagtcgtttcttgactgtgttcgctaatttatgtcacaagcatcgtgtgcgccattagccatccgggattgtaacggtgcgcgcgtagggaccggacagcggggcgcgccggggccgcctcccgagagccctgcgtgacactgccccgtgtctcccgcgcagatagcgagc

SEQ ID NO: 9602 - DNA, 226 bp, Homo sapiens
atgtgggggcaggctggggtgtggaggcctggtgtcctggatactaggggagtcatcaggagctgtggcccttccctgaggggtaattgcaggcctctgaggcttcaaggtgggctggggcaatcagggaagactccctggagtcgggggctggagcgtgacttgggtctagaatgccaggtgagccttgcaaattgggagaggctactgcatctgtgaggagcag

SEQ ID NO: 9603 - DNA, 151 bp, Homo sapiens
tgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtac

SEQ ID NO: 9604 - DNA, 396 bp, Homo sapiens
ttcggttaaaaaggcccaaaactttatttagttttcagggaaatataagatgcatgtaaacataaaatacaaaacaaaacccaaatcttacagtctagaagcatgccaagacagagcattttctgcagaccaaagagtcccgtcaaagtgataaaggacacctggaaagtggcaggccaaggggctggtcccttccccaagggcactgcatttttgtgatgagattaaaaacaaaccaactccactattaaaaatgctagaaacatggagatagtttagcaccaccattgattctggaaatatttcagcactcaaatcgactgcactgagtttaatgtcctttctccagtttctctgctgccgcggcacgaaggaaagcctgggggaaaggcttct

SEQ ID NO: 9605 - DNA, 226 bp, Homo sapiens; identical to SEQ ID NO: 9602

SEQ ID NO: 9606 - DNA, 9066 bp, Homo sapiens
tcaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggtaagtcccaatcaagatacatacgcaaggaagggtatggaagacaagttatgtcatatctgtgacactgcaaagagaaataaaaaaaaatatacactcaaatattaagttcatataacagaaagtttcaaggaattgccactctcattatggtatatattttttaaaactatttaactagcaagctgttttagtatttgtgaatagatggcattaatgaatatttgatttgatattttgaggtaaaaatgaagtgaagcaggcataaaatgcataatattaaaaactcataaataaaaacttaatatttaaacaatatatttagaatatataacatgaatcactgagttgttcgagaagcttagaaaatatcagcagagctacttatttacatttataaaaagcagagcttctttaagtagggagagccaattaatgaccaccatatcactacaggaataagtcactttacctgatgtgtgcacttctgtagagttacatgcattcattttttctattacaatatttttaatgacctacatgcttcaagttaagaaatctaattgagtattgtttaaagggtaaacaaccttttacaaataggaaaacttatttcctcatgtattattttagagggtgcatttgatataaaaaggtatttcctgcctatatccccgtatactatttcaactgtatttttcaggctgataaaaatgaaagattccaatacaatatcttctagacacagaaagcagtagtgaactgaacacaaatcaccactctcgttatgaaaattgcattctgaagcttaaaattgagtaatcataaaatcaaatgcttttatactaggcgctattctatacaattagcctgtattacttaactataaaacaaattctatctactattattatttccatttttaaaagtgaaatctaaggaacaacagattaagtaatctgcccatagttagaagctattagatggagccaggacgaagaccctagcatttagctctggagtctgttcgcctaatgacaatgctgtatcgtcacctctgagctatcctgctgcaatgaaaataattgaaatgggagtattgtggttaacttcatttggaaatcaccactacgtatttattggtgagaggtgcaattatcaaggttcattccacaaatatcaactaggcacctgctgtttttaagagctgtgctaaaggataaaagccttaagaagcttatagtctaaactgaggattattcacctgaagagattcctatggtatcatttttcaataatatgtagtgtatgaaaaatcagttatctcagaaaaaaagcaagactctgctacaagtaccagaaacgtgtattttcttctgaacttggcaatatgcttctagattggcaaacaccaaatcattgctccgacaattgcctaagcatatagctaaattaatattcagaataattgcagctgcagaacaaaagagcagttcattgcatactcattctttcccattaccacgtgtcgatattaattagcaatgaactcactaaagacgaagtcttgttaagatgcttatatctgtatgagtatgcctttttctcactaggaaattaaaacaaacaaacaaacaaacaaacaaacaaaaacaaacaaaaaacacaggacaggccgggcacggggcccacgtctgtaatcccagcactttgggaggccgaggcgggtggatcacgaggtcaggagatcgagaccatcctggccaacatggtgaaaccccgtctctactaaaaatacaaaaaattagctgggtgtagtggtgggtgcctgtagtctcagctactcgggaggctgaggcaggagaatggcttgaaccctggaggtgcagctagcagtgagccaagatcgtgccactgcactccagcctggagcaacagagcgagactccttctcaaaaaaataataataataataataataataataataataataataaaataaacacaggacatatttatgttttattttatttttgtagtatgagtacaacactatattggaaaaggttcctttaaaaggtgatttaccccttcccacaccaacgaattctactcttttgatttgaaaattatttacagcatttcagatggtgtatgtcaaaaaacattgctcttaactttttcagcaatcttatatctcaacagactcatggcctttgatgaacataactatatgtctgtaaacttagttgtgacaagtatttttgtgtttcaagttttatgtttctaatattttaagttcactagaatcacaaatacaattttctagacttttaaccttttaacatttattttgtacacatgtttctatgctttttagtttgaactcagcacatttttttttctgagctctgtgagaagcctaaaaggatcatgtagattcaaaaagaaaaaaacaaaagaaccaaacaaacaaacaaaagttgtactttataaccatttattaaaagacatccagaatgaaagaaggttgcagtctatcttgtgccttagaagaccatattcttggttttccatgctgtctctcatctggaggcagtgtggtcacttaattttgctgccaaatacatccaagtttgagattcagtctcgccacctaccagctgcatggcattggcaaatttacttcctcttatggagcttcagttgtctgttaaatgaaagtacaaggaaagtaaagtaatgctgttttttaaaaatttagcaaataaaaaaaatatacattgtcaggttccatacttgtaacttaaaagctgttcaacaaatctgtgttcttttctcttttcctataacaggaattgtattttcctatggcacaaattgtatcttcatgttaatcttctcaactgctcttaatttatggacacatttggtttaaaaatacccgttaccacattacttctgagaactgactacataaaccaagatttttttaaaaaaattgaatttattgtagtagggatttatcaaaaaggactaaagttgtcaattataatagtcattagttttgcccttattatcaggctaagagctaaacacttcattgcattaccttacttaatattcatgatagccttctgagttaaacttattaaatcaacttacaagaaaaaaattttataaaccccagaagctcgtgattttaagtcaattttctcaacgtcattcagcagttatagaacagggatttgaaactcggttgccctggactttcaattaccctaatatttgctcaagttaatactgacatgtaaattcaggagcctgaatttacaagtcattgcatttaatcctcatgatagtcttttgagtgagtgagcaaaaatgtccttctcctagaatttcaacaatggtatagacagtggagagaatgaaaaacaagtcatcccttttacagatatgggcacagagttcctacaggttaaatcacttagcagaggtcatagagctaataagtggtaggattgagactagtcactggaagaagtcagaattatttctacaatatgtagcctgatccaccctgaatgggtaactgtgactgtttttttaacatttttatatggtttaaagggaacctgacagcattatacttttgtactgagtatagtgcattacaaatagtaggctgatagtatttggtaaatgaacattagagggtatcatctttctcatactaacatataattgtgtaagtaaactaaaatgggctaacttgaaaacttcttttgaatagagggcattttaatcactagggatggatttgcagagtaggaaagatgaggcagtcttatcagaaagaaaaaagattctaacattcgaatcagaaaaactggtgttcagatgttggtactgctacttcttagctgtgtattctctagcaagttacataaaatgtattattatatatatgtgtatatatatatatgtgagtgtgtgtctatatgtatatgagacacacatgtttctatctatatatgtcagatttaggaatttctttaaaaatgtagctatttttgaatcaggaaagatagtgtaaaaccatgagtcaataaagtggcaattttccccgaatagttcaattatctataaattatcaaaaagtcattcactttctggtttacatatttggggtacatagaatattaaacagagctgagtatccagaagttacctgtggatcacaggcaagtgaagatctgtgatttctatatcaagaactaggtacagtgaggaatgttatttcttgttttacccaggacacccatgttcaaagcgccaatttaaaggagcttactatcttctgaagagcacctcaatagcagagcaatttattcctacaagatatccccctcaatgctgccattccatgaatcacagactacactggggttaaattaagactcatcaattctaaaccaaaataagatggtctagaaaccacattctgtcatgatactgttgatttccttttgttcaagtaggctgtcccatcatgatgaaatttcacagtatgaactggcatcatgtatgtttttttttttctttacaggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaaggtaaatgctttaatggtcactgtagtacatcaatattatgtctctttaaacctatgaaatgagatgttttggcctgtggtattggatggagtatgcagaataataaggattctttttttcttatgtcgtaaacaattaagtgccatgataattttgttattgataaagggagaggtcatttaggtgaatagatgtacaaagtggaggagataaaggagagtcaggaaggcaaacatttctagtcaaataggctttcctgtggtttctattgatttgagaacagttttaatgaacctgatattaggagcaaataaacttagtcaaatcctttatttaccaagtgcgttataattttataacttgaaagttatattcttttggttgttttctgagcctaatcatttggtcataaatgtataaccataatgcctcaattaaattaagtttgccacatgaaccatccctagttctctgcaaagtcaagggcaggcacattttctctttccaaaatagacatatgctttagggatcataacacacagaaattaccaagaaatgcctcatggtagaaaatgttcaagttaagaatactgctgcttctctcaattagaacctattacacagtatggattttatgtcacagcttgggaggatagctgtgtttgtggggtttgaagaacaagcgtgacaaaatgcaagtaagctttgggatgctgtgatgaagagcaaagacagagacaaagagattttaagatgtttagaaataatctagaaggagtcacttgacataagcttttctgaaactttattctatagaatattagtttcttaagatactctctgaaaatttagttctttgttgatgcccacttgaatattgctgcatactgtatttcctggtcacagcatattaaaggggctaagaaattctgtagtaaataaactggcttaactgtgtttatcccatagttaaacaaatgcattagataagaaaatcctctgtagtggtaacatctaccttatttaataaaatctaaggtgttgtacttcttgatggcaaaaggctattaaatactgcctgcatttttaatttattataataagacaggcataaattatgtttttaaattcctaaataaggcacagatttaggctgcaaaataagggccaccttgctcagcaacttataattttgcttctcactgtttactaaacaaaatgcattgctctttctttctacagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaa

SEQ ID NO: 9607 - DNA, 304 bp, Homo sapiens
gggtgcagtggctcacgcctgtaatcccagcactttgggaggccgaggtgggcagatcatgaggtcaggagatccagaccatcctggctaacacggtgaaaccaggtctctactaaaaatacaaaaaattagctgggtgtggtggtgggtgcctgtagtcccagctactcgggaggctgaggcaggggaatggcctgaactcgggaggcggagtttgcagtgagccgagatcacgccattgcactccagccttggcgacagagcgagactccatctcaaaaaaaaaaaaaaaaaaaaaaaaaaa

SEQ ID NO: 9608 - DNA, 1423 bp, Homo sapiens
gtttcagggaggatggggtcgacccttgcgatccccagaggccccccatggctcctcctgggctggctgtcttcctcctgtgggttctgatgccacctgggccgacggcgtcttctcagcccagggcggccgcgcctccggtgagtttcagctgagggcgcacggccagctccgagcctggctccgggtgcagcaccggcctgggacctctgctgtcccgcgtaggggtgccctgcaaatatgtgatgaataagtgaagaaatacgttctatcttctaacttgccggatgttagaaggaaaccaagcttatgcttctcatttatagctaccgttaaggattggacagaagcttagctttttgggtgagacggacaacagtgtttttagaacctttggcaaggaagagctggaaagaacatgtatttgaaagtgactgacaggtcttctggccctagggggccacctgagcaggtgcacccagcttccctccaagacagaaaataaattaagaaggagagcaggaagggccccggcagactccagacgggagggggtgctgcccatcaggcagaaggagcttggaagggaggggccgtggccatgggacgtggaggtgggagcgggggtcatcataggtctgcacactcgggttgagtcccccttccccatcacacacaggacagccagcagtgagctgcttaccccaaggagtcaagggggttcttgggcaacccctggtgctggagccggcagtggacagcaccgcagccagaccttgcttatttttggctcatgaggaacatctgtgaccgttccctcccctggcctggaaggggatgtgtgacctccactcaaaacagccatgcggctcctccggctgcgggcggggagggcatgtttcccagcacaggcccaggactgccagctgagaggctgggaggggcccctcacccctagactttgcatgtgaagccaagcgtggagcctcacagggaatctgagatgggagccagtgagatgggggcaggacccagaggggagaagaggtcctggggatgctgtggatctggatccagcgtgcgggagctgaggttccggagtgaaacactgcctttcatggaagcacgtcttcctgtcacccatcggcttcattttaaaggatgaaaatgtatcagacattcaaggagagctgcatcacataaaagaaagaccaggcaaagaaacggaaaataaatggattgagaaatgtgaatgactccaatcattccaatcattggaatgaatggattggataaaactccaatccatagactcagattagggagatatatttatataataagaacaggaaactgtgaagatgaaataagacaaaaaagacacttttgagattaaaaaattactgcaaaaaaaaaaaaccaa

SEQ ID NO: 9609 - DNA, 1427 bp, Homo sapiens
gtttcagggaggatggggtcgacccttgcgatccccagaggccccccatggctccttctgggctggctgtcttcctcctgtgggttctgatgccacctgggccgacggcgtcttctcagcccagggcggccgcgcctccggtgagtttcagctgagggcgcgcggccagctccgagcctggctccgggtgcagcaccggcctgggacctctgctgtcccgtgtaggggtgccctgcaaatatgtgatgaataagtgaagaaatacgttttatcttctaacttgccggatgttagaaggaaaccaagcttatgcttctcatttatagctaccgttaaggattggacagaagcttagctttttgggtgagacggacaacagtgtttttagaacctttggcaaggaagagctggaaagaacatgtatttgaaagtgactgacaggtcttctggccctagggggccacctgagcaggtgcacccagcttccctccaagacagaaaataaattaacaaggagagcaggaagggccccggcagactccagacgggagggggtgctgcccatcaggcagaaggagcttggaagggaggggccgtggccatgggacgtggaggtgggagcgggggtcatcataggtctgcacactcgggttgagtcccccttccccatcacacacaggacagccagcagtgagctgcttaccccaaggagtcaagggggttcttgggcaacccctggtgctggagccggcagtggacagcaccgcagccagaccttgcttatttttggctcatgaggaacatctgtgaccgttccctcccctggccctgggaggggatgtgtgacctccactcaagacagccatgcggctcctccggctgcgggcggggagggcatgtttcccagcacaggcccaggactgccagctgagaggctgggaggggcccctcacccctagactttgcatgtgaagccaagcgtggagcctcacagggaatctgagatgggagccagtgagatgggggcaggacccagaggggagaagaggtcctggggatgctgtggatctggatccagcgtgcgggagctgaggttccggagtgaaacactgcctttcatggaagcacgtcttcctgtcacccatcggcttcattttaaaggatgaaaatgtatcagacattcaaggagagctgcatcacataaaagaaagaccaggcaaagaaacggaaaataaatggattgagaaatgtgaatgactccaatcattccaatcattggaatgaatggattggataaaactccaatccatagactcagattagggagatatatttatataataagaacaggaaactgtgaagatgaaataagacaaaaaagacacttttgagattaaaaaattactgcaaaaaaaaaaaaaaaaaac

SEQ ID NO: 9610 - DNA, 982 bp, Homo sapiens
cggccgccagtagcagagcccagcacgttgcgggtgcccagttcatcttcgtggggctaaacctgcgggaagagagggaaagggcccttagtttccatggagatcgggtgcccaggggcggagggctcaaggctggagagcagagggacccccatcttttgtgggatcagggtgcccccagcatcttggaggcccactgaggcctgggggggcgcggtttaacctctagcatcagggacttaggcctgggggaggcgctgggaagtggcaggtggggcaggagggttctgcacctgaaggttgtgcacctggattgggggtgtagaagcggggcaggagcgttcaggcctctgggggcgtccaggcccgggcgggggagcaagcctgggggagggagctctgcacgcgttgctgggatgtggggggcggggggaggcggcatggggggaggggcgttgtgtttggaggacgcggtagccgggaccaagagctggctcagatcagggtctggaacggggacgggccgtgcctgggcctggtccccacctttggggccaaagcctgggtgcgggccttgcggatgctgcggaggacaagcggctgctgacaccgtgcggactccgccccagcagacccgtgccccagggacagtccctcccgcgcgcgcccagcgctcaatgccgtccccggccgcctagttcagcagctggctgggggcgggacggggtcgagttgcggggccgcgtccagacacggctgtgcgggcgacagctgcatcccctccccgcgccgcccctcgctcccggccccgtacccgccccagcctcccggccttacccgccacgggcctcggttggaaccgcgcgctggagtatccgtccctgaggccgcggccgagcgggaaggagcgggcgggcggcggcgcggaccctcagccggagcgcggagccgcggcgcctgggttttgcgcgaggcctccgcc

SEQ ID NO: 9611 - DNA, 640 bp, Homo sapiens
tgtatcttagggtgtataagagaagcgcaagagaaacatttaggctgttttatgtttgagtagagacatgaaagttttaaataaagcagcagcacaatgagtccagcggcacatcagaaagcaaatcaccatgatcaggtcaggttcagggtggttttatgtcatgatatatgtcagtgtgctttacctattagtggaccaaaggcaaaaaatacggttttctacagagaaagacaaagcatttgatttcaatcaacattcgtttgtggtgaaacatgttgagaaaactcatcatagaagtgaaatgttttctttgataaaggctaatctcagaagacatacgtagtggagagcttttaaatgtatttttaaaaatacgaaccaatgagaagattgcctactttcaccgcttctgtttaacacagcattggcagagctgccaccaagaagaacacagcacgttgaaggcacggtggctcctgaagctgcagccctgagacctgattgtaccatggaaggtggggtggctcctgcagctgtagccctgagacctgattccaccacaagtgctgcagctggcagaggccacaggacataggcatagctggtgaaacctgcaactgagggtgtcgggggctcc

SEQ ID NO: 9612 - DNA, 640 bp, Homo sapiens
tgtatcttagggtgtataagagaagcgcaagagaaacatttaggctgttttatgtttgagtagagacatgaaagttttagataaagcagcagcacaatgagtccagcggcacatcagaaagcaaatcaccatgatcaggtcaggttcagggtggttttatgtcataacatatgtcagtgtgctttacctattagtggaccaaaggcaaaaaatacggttttctacagagaaagacaaagcatttgatttcaatcaacattcgtttgtggtgaaacatgttgagaaaactcatcatagaagtgaaatgttttctttgataaaggctaatctcagaagacatacgtagtggagagcttttaaatgtatttttaaaaatacgaaccaatgagaagattgcctactttcaccgcttctgtttaacacagcattggcagagctgccaccaagaagaacacagcacgttgaaggcacggtggctcctgaagctgcagccctgagacctgattgtaccatggaaggtggggtggctcctgcagctgtagccctgagacctgattccaccacaagtgctgcagctggcagaggccacaggacataggcatagctggtgaaacctgcaactgagggtgtcgggggctcc

SEQ ID NO: 9613 - DNA, 707 bp, Homo sapiens
ggtacagccagcacaaaggcccgagcttgctgtgttcaaagaacagacaaaaaaaccgcatggttgaaatgtaatggaggtgtgatatgtaagatgggtgtggagaggtgcaaggtggccagcccacatggggcctcttaaagactgtggttagacaggtctacgaaaatgtcagaaagctttcaacagggaaatgttgacatcaggcttcatttttcagaagatctggcttctgtgtggagaatggactatgttgggacaaaagacgaagtgaggagattagatagatgccaattttaccagctccggcaagagaggttgaggcttatgcttggttagcactggaagtgaagaagtaggagcagactggattcttttctatcagatttggagtaccattagccgtataaatcattgtggggcggggaatgcctggtgccgtggctcgtgcctgtaatcccagcactttgggaggccaaggttgggagcattgcatgaggccaggagttccaaactagtctgggcaacacagcaagaccctgtttctacaaaaaaataaaattaaaaattaggtagacgtggtcacatgcaccagtagtcccagctactgggaaggctaaggctggaggatcttttgagcccaggattttgaagctgcactgagccgtgatctcaccacggcactccagcctgtgcaacacagtgag

SEQ ID NO: 9614 - DNA, 906 bp, Homo sapiens
atataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacactttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttga

SEQ ID NO: 9615 - DNA, 312 bp, Homo sapiens
taaatataatttatataaatttacctattttggtttatttttactaaaaggggaccatgttgctataaaactaatacatttcagaggtacctggaagaaaaatgtttaaactctgatttgcttcaaactatagtagaatatgtgtatgtttgttatcaggtgaatgggtagaatgtatttttattgtgaacatttttcttaattaatgaatatatttatttaagtgctaatgtttttttaaaggcaatagtaggcaagattcacagtgtatttcaagtgagagtctcttttcttaaatattttaatatcatt

SEQ ID NO: 9616 - DNA, 440 bp, Homo sapiens
atttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaa

SEQ ID NO: 9617 - DNA, 1572 bp, Homo sapiens
ttgaatttgacccaaagtcaggtggtcagttcatattgaaaacatagaaaatcatttgtcactttaaatgttcatgctcagtcatttctttaccacctgtctgtgtgcaacttggaaatttctggagcactgatgactgtgcatttgtgatttcctttaggatgccatttccatttaccaattgctttcctcagcctgcaattgtgtcttcattctgattagtttattccatttagattttaagaatgatagttgatgactgcctttttcccaatgttacaatagtagaaatgtggtatcttacattttccaaacattttcttctcctgggctttcctgtaccgttcagtgatggagagctcacagttcctattgagatatttattttcattactatccttacatagaacgcatttccagaactttttccttccattcaacttatagctcctctttaaaaacaaaattattctatactccatgctttgatactctaaattcaaccggtcatatttttttttcttttcctttctctttgactggtcaattcagaaaaggaagtccagttcgagtgttcagatgatggtgaggatctatctgccagatttctcctcctgtgaaaattcacacttaggaataaaagtcttatttacctaagatagtgtaagtaagtggagagggtgtaggaccattacaggtcagtgttagtcaactatcaaaacacggtacttctcttacatattacattgttttttctctgaaattgaatttgttatacatgtagatagtatattaagaggtttgctcttttacaaagtcaattttctctttgaaaataaaaagaccatgacagaatgaatgtctgtatagtgatcagtaaaaacaaacaaacaaaaaactatatgttttttttaatgttctttatggttgctaaaataggagtgatttataggacaccataatacattcaccatggagtttataaaggtgtgaaagtgatcttacaatgtaccaatcctagttaagtacctttaaaggaaatgtttattaaccttcaaacaataaatttaacacctgagaaataggaatatcttgcccatgcctcataagagtaattcagtgcatcatacaattatctgatttgattgattcatgattttttaaaaaagaaaaacaccttgcttctattaacataaaataattatatcacacaaaagtgccagagtttttgtatttttaaaagacatctatgggccaggagcggtgtctcacacctgtaatcccagcagtttgagaggttgagacagacggatcacctgagatcaggagttcgagaccagcctggccaacacggtaaaaccccatctctactaaaaaaaaaaacaaacaaacaaaaaacagaaattagccaagtgtggtggccgtacctgtaatcccagctactggggaggctgaggcgggagaatcacttgaacccagaaggcagaggtttcagtgagccgagatcgcgccatggcactccagcctgggcaacaagagcgaaactccatctcaaagaaaaaaaaaaaagac

SEQ ID NO: 9618 - DNA, 445 bp, Homo sapiens
cccaaaatagaaataaaagtatctcagaatatttctttcatttgcattcactgataaaaactaaatatagcatattaaatacatgtggtgctttaaccataagtgcccctgttcatttgacaggaagccggctatgttttgcctagcatgtttcccgaataggaaattattcgtgtgtgcatccctccccttttctcacgtaccctgtactaacataaatactgaattttgatccctctttaatagactttttacctcttatctctttggctcttgcacaaatatcatgttaaattctgtgcactttgatttaaaggaaaaaaaaggttttaactatctgcagaatatagattgatgacaacatttatagaattttccagtaaaggaaagtttagaagttttctcatccttttctgtgggtcaagcagcacagtgtcacaactta

SEQ ID NO: 9619 - DNA, 344 bp, Homo sapiens
ggattatatatgaaatagtcatgaaaaaataatgttgttatacaatatagagttcctatagaaataattaaatgtcttaatctctctgatttactacagttccaaactaccatggtgacctaaaagtctgtaaaaaccaaatgcttttccaaataattatgctgcatacgtgaaggccactgaaatatatagcctgaaaaatactcacatttgggtatggaaaatagaatgtcaaatgtctaaattaatctgcttgggcagtttttataaaggtcttaattattccttgtttctgtcataaggtgttgagatatattcaagatgaatgatctgaacaaatatta

SEQ ID NO: 9620 - DNA, 4699 bp, Homo sapiens
ggaaacagccacctctgtccacggtgcccgccgatggatacattctggagctggatgatggcaacggtggtcaattccgggtcagtagacagcccactacgtacttgttaacccaaagcagtgactctgtcagaggacctgccagggagtctcagggctggcttccccatctctcctggggacaggccatcctggcagggcctgcctgcccttcacctgaagcctgctttctccctctaccgtgaaggtggatggagcagtctctgaaactgccctacccttcttatgagacaggacatgcagtactggagtcagactgcctgcattcaagttggtctcctccaccctagctatgtggacaatgcctaattatcacccctttgagtcttcaggtcctcatttattaactagagggatgataacaatagcgtgaatctcatgctttgttgctaagagtccattagataattcatacaaaattcttagcatgctgcctagaacatagcaagcgttcattattagttattattattaccatcattgcttattgctaataatataattaaccgttgtccaagatttatttctgcaatccacagcttctaatgtctttgattggcattcctcttaattgacatggtctcctgttatagcttccctattctaagcaacctttctagcaaaggtttccccagttctatagttttgttctgggcctttcaccagatagaactggtaccagaagattgctaccttcccaaggtgagggagccctatccccattgagaagctcatgctgccctctgaaggcaggacagaatggcctcctggtaagacacagctgtggtaccaccagattgatgattcatgtgccaccacctgccggcatgtgtctgcttctctcatacagagcttcattctcatccatcctctccctgccaccctactttccatcctctccaccctagtcttgcctggaagttctgatgcttggagcttcctaagggagcagccgttctggggactgaggccagttcctgcactgatgaagaggagacccctgtctaaaaaaacctcaggcccgtgaggatgaggctttcttctggtcaccaatagccaaacctgagccactagctttcaagagcaaagcctctcaaggcccccttttcctgaatgtgtttttgatcccccactaggtttaagtacttgagagcaggggccttgtcttctacaattctcctcaaggacaaaggttctctcttttgatagagaagccttatttacatatatgttgatttattggcatgataaaatctaatttctttctttccaagataagggcctcaggttccatttcatgtcttttgcagtgtgtgtgagagtgtgtgtgtgtgtgttgtgtgtgtgtaaaatcctatttgtcagtttctcattcctgactttgccttttcagtgcctgtgtcattttcagggcctttcttttccctttattatcttttttttctcctgggaaagtaactctcccggttttcccaattctttaaataattatcttattttgtcttgactttttcctctactcaaaagtgcggtcctcccccagcagcattggtttcacctgggaacttgttaaaaatgcaaaatcgagaccctaccccagacacctactggatcagcaactgcatttttacaagatcctcaggtgattcatatgcacgtaaagtttgagaagcactgaatgagaggacataatattccaatttttgttattccagcaggagtaatgaattgatgggtgatccaagaccgtggtcttcttagtatcctaccagagagttgtcatattaaggctgtgctttgaatgcaaattatttttattcattacatcagcataattttgcaatgtgtacagctgaagagggaggcaaatgcctaacctatgctaaagacgcattatgctaggatttattttaagcctttgaaatgtcattcttcctcctttccctgtttcctcccccttccctctgtactgtgatgaaaacctatccccggtggcttggagtgtaatctctgtgacagttctgaagttatcagcggagttctaaacataggatagagaccaccttcctgttttcatggtttcaaacatgttttttacaaaccatactgatggataaggagctcagtaggggctatatactgtaccaatcccaagttaataagtgtaatctgaactataagcactcagttttattttttttaagccctagctgctaataactaccattcattaggctgcctggcccatgctaaatacaaggcatgacgctaatctgcatatacaacattaagtaatcctcacaccaacctcataaggtggatattattatcccattttacagattaggaaactgaggctaaaaaggtaaattaaatggcccaatatctcacaggattcaaatccagattagaatgacaccagggctcttgctcctaaccactgagcgacactgcctccctcgcccctcagaagggggcaggctaagtgctgtcctgttctttgctgactctcaggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgagggtaaggcccttcagcagtatccctcagagcgagaactgcgtggcatctaaagtggctggcaagcccggaggtaaccccaccactgcccacattcctgaagtgtttccatgacttgctctgcattctgcacagagccgctgttcctctcctgcctttagagagcctatggtatgtggatgtgatcaaaccaaagattccacatcggcagttccaatggcttgggccggcggcttcctttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaatttttgcttcttagctatactttaaatattttggtcatcaaagacaagtaatgtgtctcagatgagaggcttgaatttgatggccagatataacctctgaggcttttaacattttcattttaagagtaagcaagacacatgaaattaaacctacaaggaggtatttgtggctggtgccaaagcattctgacactttggggtgtcattttaatcaaagaaatcacccccccacctcaccgggattctccataacttccctctgcagaactaattatgttgattttgttcaagttcaagatgttagctaaaagaactatggtggtgttttttttcccacttcccacaaacctcaacatgtgccagtcaccctaaaatgcttcacatggttaaaaacaagcacaattttgaatcctacagcaaggatgaaaggcccctagccgtgaaaacagtgctttggggagcagttgtcagtctaagtgatgctattccaagagaaggatatgctgagggaaaatgcccacatgacctgttcccatttggagtacagtgatgtggtagctacagcttcccccagaattatcattttagcaccttctctcagggatgacctatcagtttgagagcagttgcctcttttctcaaaataccatactaactgctaaagccctccaagagtctttcctagatgcaacgcagaaggcccttgctggtgatggcctcatttcccatgtgtgtacaaggtggtttgattgaagagtgaagtgcatgcctgcagagcagagagaaatttgtagcaatgttgctaatatgtgttatcagatctgcgggaaaactatttctattcataatacatcatgggaatcatactattctggtaaaaatcagttattagcataacagcctgagcacttatgtctctcgtttcatcctgcaggaggatgtagcgcctcagtttattttaatgttcataagattatggtgtctaatttaataaattacaggattggaactgcgatccttggtaccacagtcacagaactgggggtcattttctagatgaaacaaacggaacaagttctcttccaacaaagaaactgtactgtagaaattaatttcctccatgaattttatatattgtgtacaaatataaggtatgtatctgaatacaaagaaaagcctatcatcatatagatatcagtattctctgttactgcacagaagtaattttctcatgatgaaataaagttcacacacatactttctccataa

SEQ ID NO: 9621 - DNA, 311 bp, Homo sapiens
gcacagcggccgggcgcggtggctcacgcctgtaatcccagcactttgggaggcagaggcgggcggatcacgaggtcaggagatcaagaccatcctggctaacacagtgaaaccccgtctctactaaaaatacaaaaaattagccgggcgtggtggcgggcgcctgtagtcccagctactccggaggctgaggcaggagaatggtgtgaacccgggaggcggagcttgcagtgagccgagattgtgccgctgcactccaacctgggcgacagagcgacactccatctcaaaaaaaaaaaaaaaaaaattat

SEQ ID NO: 9622 - DNA, 1657 bp, Homo sapiens
gcaggaactacactggaagtggggaggggcagtgtgctctgggtagctgtcctcctctgtaatggcaggagctgggtatgcctcgtgacctcttggactcctgctcacattatcactgctgccttcccagatgagctgtgcaaatagatggcggccatgagtggaattggaaacgaggttggagggagcttctgtctgtccagtttggggcctgccaagcctggcatggtgagggtatggtggagccaggaggggccactatgggagccgggccaggaagctgcattctactgagccttttacctcttgcaaggacctgcctttcaggagactttggtctctaaaggccagggatggaagcttcagggagagctctccagctcctgtttagctctttggttcagacctaagtggcgagccacttgactggatgggacctccagccagccacagcattggaatccagcctggctcctgcactgcctttcatattgatgtccatgacaatcccagctgtcttgcagtacatggcacaggcagccctggcatcttgaggagggtgttcagtgtggtccctggcagaatatgagcctggggcagacaggatgtggctttagaccgtgaacagggagccatgccccaggacatacgaccctgtgccccacactcgcccacactcactcctggtcattaatcacagtgctcatgggcccctgattcaaaggaagtgccagctgtacatgggcccaatgaactttactcaagattagaggactgtttaggggcatttgaaatgaattgtggaaaggacatttgtgagaccatttgaaaggtcactcaggggtggtacaacaggataaataatgaacccattacaaggttctagtgaaccactgtggccttgggaactgaatttcatcactttggaagccagagaaaggcactggaaatagctttgcctttgcacagaggggagttttcttctgcttaactggatccaattagaaagtgattcaccgaacacttattctgtgcgagggtcttacagtaaagactcagtgtggcaaggcccctgttttccaggactttacaatcctagttgggagtggggtgaggtcaggggtgtgtaagttgaacactatgatgagagcaccctgaggcggatgcagccagctccctgtgaacatggacaacatgacagggctgggtctagacactggaaatgggtccacctggtttactagacttgagctgaacccatttgtacaattagaggaatttatctattcaccaaatatgcatatctcttcaattattaaagactaccatgtcctactttcagtcgcccagaaatagaccctgcaattccagtgccagtaactcatgtcagaggtgatccctggagacactgcaggagagtgggcaggaagacagggagtgaaggtaggcagcaacggttccttatccagcaagtcatgagtatggcagccaggtctcatcctgtacagaatagccctcagcatcatccccaccaaggggcaaggaagccgggtgttcattcccccacctccctctgtcattggctgagggctgcattgaggcattaactacccagggattctgccatgtcctggtaggagaaaaaaaaaaaaaaaaa

SEQ ID NO: 9623 - DNA, 1659 bp, Homo sapiens
gcaggaactacactggaagtggggaggggcagtgtgctctgggtagctgtcctcctctgtaatggcaggagctgggtatgcctcgtgacctcttggactcctgctcacattatcactgctgccttcccagatgagctgtgcaaatagatggcggccatgagtggaattggaaacgaggttggagggagcttctgtctgtccagtttggggcctgccaagcctggcatggtgagggtatggtggagccaggaggggccactatgggagccgggccaggaagctgcattctactgagccttttacctcttgcaaggacctgcctttcaggagacttcggtctctaaaggccagggatggaagcttcagggagagctctccagctcctgtttagctctttggttcagacctaagtggcgagccacttgactggatgggacctccagccagccacagcattggaatccagcctggctcctgcactgcctttcatattgatgtccatgacaatcccagctgtcttgcagtacatggcacaggcagccctggcatcttgaggagggtgttcagtgtggtccctggcagaatatgagcctggggcagacaggatgtggctttagaccgtgaacagggagccctgccccaggacatacgaccctgtgccccacactcgcccacactcactcctggtcattaatcacagtgctcatgggcccctgattcaaaggaagtgccagctgtacatgggcccaatgaactttactcaagattagaggactgtttaggggcatttgaaatgaattgtggaaaggacatttgtgagaccatttgaaaggtcactcaggggtggtacaacaggataaataatgaacccattacaaggttctagtgaaccactgtggccttgggaactgaatttcatcactttggaagccagagaaaggcactggaaatagctttgcctttgcacagaggggagttttcttctgcttaactggatccaattagaaagtgattcagcgaacacttattctgtgcgagggtcttacagtaaagactcagtgtggcaaggcccctgttttccaggactttacaatcctagttgggagtggggtgaggtcaggggtgtgtaagttgaacactatgatgagagcaccctgaggcggatgcagccagctccctgtgaacatggacaacatgacagggctgggtctagacactggaaatgggtccacctggtttactagacttgagctgaacccatttgtacaattagaggaatttatctattcaccaaatatgcatatctcttcaattattaaagactaccatgtcctactttcagtcgcccagaaatagaccctgcaattccagtgccagtaactcatgtcagaggtgatccctggagacactgcaggagagtgggcaggaagacagggagtgaaggtaggcagcaacggttccttatccagcaagtcatgagtatggcagcacggtctcatcctgtacagaatagccctcagcatcatccccccccaggggccaggaatccgggtgttcattcccccccctccctctgtcattggctgagggctgcatttgaggccttaactaccccgggattttgccaagtcccgctaggagaaaaaaaaaaaaaaaaaa

SEQ ID NO: 9624 - DNA, 1659 bp, Homo sapiens
gcaggaactacactggaagtggggaggggcagtgtgctctgggtagctgtcctcctctgtaatggcaggagctgggtatgcctcgtgacctcttggactcctgctcacattatcactgctgccttcccagatgagctgtgcaaatagatggcggccatgagtggaattggaaacgaggttggagggagcttctgtctgtccagtttggggcctgccaagcctggcatggtgagggtatggtggagccaggaggggccactatgggagccgggccaggaagctgcattctactgagccttttacctcttgcaaggacctgcctttcaggagacttcggtctctaaaggccagggatggaagcttcagggagagctctccagctcctgtttagctctttggttcagacctaagtggcgagccacttgactggatgggacctccagccagccacagcattggaatccagcctggctcctgcactgcctttcatattgatgtccatgacaatcccagctgtcttgcagtacatggcacaggcagccctggcatcttgaggagggtgttcagtgtggtccctggcagaatatgagcctggggcagacaggatgtggctttagaccgtgaacagggagccctgccccaggacatacgaccctgtgccccacactcgcccacactcactcctggtcattaatcacagtgctcatgggcccctgattcaaaggaagtgccagctgtacatgggcccaatgaactttactcaagattagaggactgtttaggggcatttgaaatgaattgtggaaaggacatttgtgagaccatttgaaaggtcactcaggggtggtacaacaggataaataatgaacccattacaaggttctagtgaaccactgtggccttgggaactgaatttcatcactttggaagccagagaaaggcactggaaatagctttgcctttgcacagaggggagttttcttctgcttaactggatccaattagaaagtgattcagcgaacacttattctgtgcgagggtcttacagtaaagactcagtgtggcaaggcccctgttttccaggactttacaatcctagttgggagtggggtgaggtcaggggtgtgtaagttgaacactatgatgagagcaccctgaggcggatgcagccagctccctgtgaacatggacaacatgacagggctgggtctagacactggaaatgggtccacctggtttactagacttgagctgaacccatttgtacaattagaggaatttatctattcaccaaatatgcatatctcttcaattattaaagactaccatgtcctactttcagtcgcccagaaatagaccctgcaattccagtgccagtaactcatgtcagaggtgatccctggagacactgcaggagagtgggcaggaagacagggagtgaaggtaggcagcaacggttccttatccagcaagtcatgagtatggcagccaggtctcatcctgtacagaatagccctcagcatcatccccaccaaggggcaaggaagccgggtgttcattcccccacctccctctgtcattggctgagggctgcatttgaggcattaactacccagggattctgccatgtcctgctaggagaaaaaaaaaaaaaaaaaa

SEQ ID NO: 9625 - DNA, 2068 bp, Homo sapiens
gtgccattccacaggtagaaacactcacatgtgcttagaaacgctctgctttcctccttgattacccaaattctcattctgagcttctatttctccagatctagactcgggaatttaatatctgaagactcatatagggctgatctaccctaacttgcaaaatttcatgcatatttcatacttacactcttcatatgtcagtggtgctattgtttggctactttctctatctgtgtggtttcatcaccagtctattcacccctatataaaacttaagatttgagataagaactggaatttaaatgacttaggaaagaatgtatcttggttagaatataagagtctgaaaagtctgctgtgggtgctaagctggctactaagggaaatgctaacagaaatttgtcatatgtcttcagagtattgtctggcaactgattaaaacagaggaagagtgaaacaacatctgcttctctccacctcacactgataaaatggttgaataaatgcactttgcttatggccatgaagaacacaggggacttcatctttccaagtgttttcatacaatgctcaaggctaattcttttggtcctgatgttttatttcttagcacctgctggatcaagaagcacccacaaggatcatttctcaaaaatgtctgaaactatatctattctgactatgaaccttgatcacaattcaaacccttaggctactgttctgattgttttcagcattacccactaacttttgctttctatttccatattctgtattctgggggcactttttatacagagtctgaaagtgctattcttttttttttttttttttgagacggagtctctctctgttgccaggctgcagtgcaatggcacgatttcggctcactgcaacctctgcctccggttcaagcaactctcctgactcagcctcccgagtagctgggactacaggcgtgcaccaccacacccggctaatttttgtttttagtacaggcggggtttcaccatgttggccaggatggtcttgatctcttgacctcctgatgcatccgcctcaggctcccaaagtgctgggattacaggtgtgagccactgtgcccagcccgaaagtgctattcttattatgacctacagtggtaatatttcacttaaaaatcagtgctatgcccattgctggttaacaagctttggagaagtattaggttgaaccatagaaactgccacaactgttcaaatattgaaaattttatatgcttcagctcatagtctccttcacacacattctctttcatatttttttataattttattttttgtatgacttaatgggcacatgctgatttcctgtatgtcgtcaacactcctgagccatgagggtaagatcagagctgcaggagtccagacacgtactttgtcgcctgccaagtgaaagacaatgaatggagttatctaaatttttcagtgaactttttggtgtctatgttgtctaattttattcccttactttgtgtttaagaaagatctaatacccacagagaataccaaggctattaaagtctaagcaggtgacctacctcaaagcttaagttcctgttatcataggcctcgtttctcaaatttgtataaatgtacatgtgatggaaaaccagaagatgcttggtaaacatggtcagttttactcaatgatgaatggtttcagtcatttttttgtattaaaggaaacataaatatactatggagtaaaatgcaaacactacacggttttttaagataaattctgacacttgaaaggcatgttctgcatttagggctattgccagccccagaaccatgggatgaagttttactccttctgctggtagaggaagtttagtggaaggtttgagaacctgagccctgagtgtaggaaatgcatagaagtagcaaagtctgaacaacactgagaactacacagtaaaattagcacataggatttattatcctttgttgaatgagtatatgagtatatgatgatgctgctgatgatgatgacaatgaccacgatgatttaaaaaaaaaaaaaa

SEQ ID NO: 9626 - DNA, 2071 bp, Homo sapiens
gtgccattccacaggtagaaacactcacatgtgcttagaaacgctctgctttcctccttgattacccaaattctcattctgagcttctatttctccagatctagactcgggaatttaatatctgaagactcatatagggctgatctaccctaacttgcaaaatttcatgcatatttcatacttacactcttcatatgtcagtggtgctattgtttggttactttctctatctgtgtggtttcatcaccagtctattcacccctatataaaacttaagatttgagataagaactggaatttaaatgacttaggaaagaatgtatcttggttagaatataagagtctgaaaagtctgctgtgggtgctaagctggctactaagggaaatgctaacagaaatttgtcatatgtcttcagagtattgtctggcaactgattaaaacagaggaagagtgaaacaacatctgcttctctccacctcacactgataaaatggttgaataaatgcactttgcttatggccatgaagaacacaggggacttcatctttccaagtgttttcatacaatgctcaaggctaattcttttggtcctgatgttttatttcttagcacctgctggatcaagaagcacccacaaggatcatttctcaaaaatgtctgaaactatatctattctgactatgaaccttgatcacaattcaaacccttaggctactgttctgattgttttcagcattacccactaacttttgctttctatttccatattctgtattctgggggcactttttatacagagtctgaaagtgctattctttttttttttttttttgagacggagtctctctctgttgccaggctgcagtgcaatggcacgatttcggctcactgcaacctctgcctccggttcaagcaactctcctgactcagcctcccgagtagctgggactacaggcgtgcaccaccacacccggctaatttttgtttttagtacaggcggggtttcaccatgttggccaggatggtcttgatctcttgacctcctgatgcatccgcctcaggctcccaaagtgctgggattacaggtgtgagccactgtgcccagcccgaaagtgctattcttattatgacctacagtggtaatatttcacttaaaaatcagtgctatgcccattgctggttaacacgctttggagaagtattaggttgaaccatagaaactgccacaactgttcaaatattgaaaattttatatgcttcagctcatagtctccttcacacacattctctttcatatttttttataattttattttttgtatgacttaatgggcacatgctgatttcctgtatgtcgtcaacactcctgagccatgacgggtaagatcagagctgcaggagtcccgacacgtactttgtcgcctgccaagtgaaaggccaatgaatggagtttatctaatttttccagtgaccttttggggtgtctatgttgtcaaattttattcccttactttgtgtttaagaaagatctaatacccacagagaataccaaggctattaaagtctaagcaggtgacctacctcaaagcttaagttcctgttatcataggcctcgtttctcaaatttgtataaatgtacatgtgatggaaaaccagaagatgcttggtaaacatggtcagttttactcaatgatgaatggtttcagtcatttttttgtattaaaggaaacataaatatactatggagtaaaatgcaaacactacacggttttttaagataaattctgacacttgaaaggcatgttctgcatttagggctattgccagccccagaaccatgggatgaagttttactccttctgctggtagaggaagtttagtggaaggtttgagaacctgagccctgagtgtaggaaatgcatagaagtagcaaagtctgaacaacactgagaactacacagtaaaattagcacataggatttattatcctttgttgaatgagtatatgagtatatgatgatgctgctgatgatgatgacaatgaccacgatgatttaaaaaaaaaaaaaa

SEQ ID NO: 9627 - DNA, 2067 bp, Homo sapiens
gtgccattccacaggtagaaacactcacatgtgcttagaaacgctctgctttcctccttgattacccaaattctcattctgagcttctatttctccagatctagactcgggaatttaatatctgaagactcatatagggctgatctaccctaacttgcaaaatttcatgcatatttcatacttacactcttcatatgtcagtggtgctattgtttggttactttctctatctgtgtggtttcatcaccagtctattcacccctatataaaacttaagatttgagataagaactggaatttaaatgacttaggaaagaatgtatcttggttagaatataagagtctgaaaagtctgctgtgggtgctaagctggctactaagggaaatgctaacagaaatttgtcatatgtcttcagagtattgtctggcaactgattaaaacagaggaagagtgaaacaacatctgcttctctccacctcacactgataaaatggttgaataaatgcactttgcttatggccatgaagaacacaggggacttcatctttccaagtgttttcatacaatgctcaaggctaattcttttggtcctgatgttttatttcttagcacctgctggatcaagaagcacccacaaggatcatttctcaaaaatgtctgaaactatatctattctgactatgaaccttgatcacaattcaaacccttaggctactgttctgattgttttcagcattacccactaacttttgctttctatttccatattctgtattctgggggcactttttatacagagtctgaaagtgctattctttttttttttttttttgagacggagtctctctctgttgccaggctgcagtgcaatggcacgatttcggctcactgcaacctctgcctccggttcaagcaactctcctgactcagcctcccgagtagctgggactacaggcgtgcaccaccacacccggctaatttttgtttttagtacaggcggggtttcaccatgttggccaggatggtcttgatctcttgacctcctgatgcatccgcctcaggctcccaaagtgctgggattacaggtgtgagccactgtgcccagcccgaaagtgctattcttattatgacctacagtggtaatatttcacttaaaaatcagtgctatgcccattgctggttaacaagctttggagaagtattaggttgaaccatagaaactgccacaactgttcaaatattgaaaattttatatgcttcagctcatagtctccttcacacacattctctttcatatttttttataattttattttttgtatgacttaatgggcacatgctgatttcctgtatgtcgtcaacactcctgagccatgagggtaagatcagagctgcaggagtccagacacgtactttgtcgcctgccaagtgaaagacaatgaatggagttatctaaatttttcagtgaactttttggtgtctatgttgtctaattttattcccttactttgtgtttaagaaagatctaatacccacagagaataccaaggctattaaagtctaagcaggtgacctacctcaaagcttaagttcctgttatcataggcctcgtttctcaaatttgtataaatgtacatgtgatggaaaaccagaagatgcttggtaaacatggtcagttttactcaatgatgaatggtttcagtcatttttttgtattaaaggaaacataaatatactatggagtaaaatgcaaacactacacggttttttaagataaattctgacacttgaaaggcatgttctgcatttagggctattgccagccccagaaccatgggatgaagttttactccttctgctggtagaggaagtttagtggaaggtttgagaacctgagccctgagtgtaggaaatgcatagaagtagcaaagtctgaacaacactgagaactacacagtaaaattagcacataggatttattatcctttgttgaatgagtatatgagtatatgatgatgctgctgatgatgatgacaatgaccacgatgatttaaaaaaaaaaaaaa

SEQ ID NO: 9628 - DNA, 7025 bp, Homo sapiens
ggtacagcctgtacacccgcacctggctcgggtacctcttctaccgacagcagctgcgcagggctcggaatcgctaccctaaaggccactcgaaaacccagccccgcctcttcaatggtgagctctgactgccccggccagcatcccccattctgtgcccccaccctccccgcctgctccccttcacataccccagcccctgggctccctgcctgttaccccgcccacagcccatctctgtccccaggagtgaaggtgcttcccatccctgtcctctcggacaactacagctacctcatcatcgacacccaggcccagctggctgtggctgtggacccttcagaccctcgggctgtgcaggtgaggggagggcagggagcagggggtgcctggagtcaccttggggactggcagtttcgccttgctagagagggctgacccttgtccgtctgcccgtgggatgtgtcccatatgctccatgttcacacgtgcacatgcgcacacatagcctggggaaggggggtacagggcatggctgggcagaaggggagagcaggagtgggggatgcagagccagagggctgggggtgttggcccaggactctgggtctagtgagtttccaggctggctttcactcccattggcccccttcagaccccctttctttctgtcacctctgtctgtcagtatctgggtctctctgtctttccctcccattccttatctctctgtgtctgcctctctctatgtacaagtgtccctctgcctccatgtgccccgtgcttcacattcctggatctctcccctccagctccatccctttcctctgcttcatctctccatgctctcctctcctctccaccagcgcccacactcctggctcttgctgcttcaagtgcctcttgcatcctgctccccagtctccaaacctcctctctctcgcaggcttccattgaaaaggaaggggtcaccttggtcgccattctgtgtactcacaagcactggtaaggggctcccgtcttccctggcccacccttgtcccagctgggcttgccaggactgggcccattgaggacggccggggccagagatcaagaagtcagtacgggccggcacccgccttcctcgtgaagtcacctggacaccagcagggagggaggagaggggacagtctcccaccactccattgatcaagcttctgaagccccagagggcagggcagtcatttctctttcatttcatgggcatgtattagatacctactgcacactgggcatggacaaaagttatgactcttccatcaaggaaattctaagaccaataggggaggtagccctgtatcaaagtatataacagcggaggcaagagggttgggagttcaagcccaacctgggcaacatagtgagaccttgtcttcaaaaaagaagtatgtgatatttaggtaacagttggcacagggaacagggatgggaggcccaggcacggtgtgatcagatccacttggagaattgaaagatgatgacctgagctgagggttcaggaagctcggctggcattggccagcttgagttgttgggggcgatgttctgggcaagggaacagcttgaacaaaggcctagaggtgtggacaacttggcttagtccagaagccacagccccagcacttaaaggcctggagatgctgtggtaaagaagggggcttaggtacagttgcccctcgaagccccctgcctgtctctgctgtcctgcagggaccacagtggagggaaccgtgacctcagccggcggcaccgggactgtcgggtgtacgggagccctcaggacggcatcccctacctcacccagtaagtccctgacctaggcaagggatggcccttccatgggccctttcccccacccccagccttcagtgaagtgtttcaggggtatcagcaggtggatctttgccagtgcccttcctggcccaatcccagcctatctgaagactggcactgcccatcccccaactgatccagccatagtccccaaaagaggaaagggggagggttcggacctgagacccgaggcactggggtgacttcttttgtatggaagcccactctcttgtgaatcacccagccccttgggcctgggatggggacagggatcagcatggcacagatccaataccttctgtcccctgctcccttgttccccagtcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtggtgagtttccccgaaagagagaggagctgggagaggagggagagacagaagccagggcagccacagtcccatggagagcactgaagccttagttttagcacagatgttgccgtggcagttacttccatctgtgttactcagattggttttaatccttgagacttcccttggggcaccttgggaggctgaggcaggaggatcacttgaggctaggagttggagaccagactgggcaaaatagcaagactgtctctacaaaaaaattttaaaataggccaggcgtggtggctcatgcctgtaatcccagcactttgggaggctgaggtgggaggatcacctgaggtcaggagttcaagaccagcctggtcaacatggtgaaaccccgtctctactaaaaatacagaaattagccgggcatggtggtgcatgcctgtaatcccagctactagggaggctgagacaggagaactgcttgaacccgagaggtagaggttgcagcgagctgagatcgcgccactgcactccaacctggaagacagagtgagactctgtcacaaaacagaaaaaaaaatttaaataatataaataatataggccaggagcagtgactcaggcctgtaatcccagaactctgggaggccaaagcaagtggattgcttgagcccaggagttcaagaccagcttgggcaacatggtgaaaccccgtctctacaaaaaatacaaaaattagccagtgtggtggtgagcccaggaattcaaggttgcagtgagctatgattgtgccactgcactgcagcctgggcaacaatgagactctgtctcaaaaataaaaaagacttctgccagctgcgggacagaatgggagaatgtctgtagctgagtaaagccctgcagggaattagtttcccctgggtggagactggttctctgatacagtgactggcaggactaggttatgaaaagttaagaacagctaggtgagtgggtgggtgaggatcacaagtcccaggctgcatgaaatcccaaagggcagcctaggcgaagaagtgttccgtgggaaagagcagccctgcgtctaccaagcctggggcctgcagcccgaagattccacagcccctcccttcaggtgtcactgtgtgcaacggaggcctcggatgggcttggtcagggggtgaccagttgggcccagttcccagtgaggagggaatagatgcctggggtgggtctggaaagtgcacagtcagggctgacggccagccagagcattacaagctggttcccacctgtctgggtgtgccttatgccatattgtgttatcctggcaccttgtgacataccctccaacccccacccagggcggacctttgagggcaatgcagagaccatgctgagctcactggacactgtgctggggctaggggatgacacccttctgtggcctggtgagacacccccttactactccccatcctccagccccacgctcagcctgggacaagggccttcccaccccctcactcccctagaaagcaggccagcccagttcctggcccagaagcgacacagctccacctctaggggtagggacagagttctggcctcccttcttcctggagtgctggctccgtaccacctctgcttctcacactaccttcccctgccagtcagccttcagcctcttgggagccttgcaggccccagggcattccagagagatgtctaattgttcatagccttagcccagaacagaaaatagcctttgcttatctggggagaagtcagtaaatccactctgcatgtaaccattgccttgtggtgcataaaaacattcacagatatctgttaatcctcagaacatatattcattcattcattcattcatcaagtactttatgtgcacctaacacataccaggctctgttccaggcaccaggaacacagcaggtacatctgtgtctggtggcatcattgttctctccacttgccaaatgagaaaattgtgcctcagagaggggccatgactagaccgaggtcacatgctaggcttggtggagtcagggctagatgcaggcctgccagctccaggtctagtggttttttcccctggaactattgccaccttttcacccatggctgacttgtgcccacagttagagaagcagctcctggcagttggggttttcctggaagtgctgacctcatccctagttgtcaggtgcccatcagcctggacctggggcagggaagactgttctgactgtaccaccaatctctctctgctctgtgtctcaccctcatggctgtcggtaggtcatgagtatgcagaggagaacctgggctttgcaggtgtggtggagcccgagaacctggcccgggagaggaagatgcagtgggtgcagcggcagcggctggagcgcaagggcacggtgagggactcggggtccaggaggagctgtgtgggcaggcactcagccccaacgggaacccatccatgctgaccccaggcctgcgagcacctccccaaaactctgacctctttggcccatgggccctcaagtcagaactcctgaactccaggatggggcaggggtcgggtcaggcttctctgtcttgggtccatttcccagcttctctccaccaaacctggttcctctcacccacagtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaa

SEQ ID NO: 9629 - DNA, 3304 bp, Homo sapiens
gggcggacctttgagggcaatgcagagaccatgctgagctcactggacactgtgctggggctaggggatgacacccttctgtggcctggtgagacacccccttactactccccatcctccagccccacgctcagcctgggacaagggccttcccaccccctcactcccctagaaagcaggccagcccagttcctggcccagaagcgacacagctccacctctaggggtagggacagagttctggcctcccttcttcctggagtgctggctccgtaccacctctgcttctcacactaccttcccctgccagtcagccttcagcctcttgggagccttgcaggccccagggcattccagagagatgtctaattgttcatagccttagcccagaacagaaaatagcctttgcttatctggggagaagtcagtaaatccactctgcatgtaaccattgccttgtggtgcataaaaacattcacagatatctgttaatcctcagaacatatattcattcattcattcattcatcaagtactttatgtgcacctaacacataccaggctctgttccaggcaccaggaacacagcaggtacatctgtgtctggtggcatcattgttctctccacttgccaaatgagaaaattgtgcctcagagaggggccatgactagaccgaggtcacatgctaggcttggtggagtcagggctagatgcaggcctgccagctccaggtctagtggttttttcccctggaactattgccaccttttcacccatggctgacttgtgcccacagttagagaagcagctcctggcagttggggttttcctggaagtgctgacctcatccctagttgtcaggtgcccatcagcctggacctggggcagggaagactgttctgactgtaccaccaatctctctctgctctgtgtctcaccctcatggctgtcggtaggtcatgagtatgcagaggagaacctgggctttgcaggtgtggtggagcccgagaacctggcccgggagaggaagatgcagtgggtgcagcggcagcggctggagcgcaagggcacggtgagggactcggggtccaggaggagctgtgtgggcaggcactcagccccaacgggaacccatccatgctgaccccaggcctgcgagcacctccccaaaactctgacctctttgcccatgggccctcaagtcagaactcctgaactccaggatggggcaggggtcgggtcaggcttctctgtcttgggtccatttcccagcttctctccaccaaacctggttcctctcacccacagtgcccatctaccctgggagaggagcgctcctacaacccgttcctgagaacccactgcctggcgctacaggaggctctggggccggccgggcccactggggatgatgactactcccgggcccagctcctggaagacgtccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaa

SEQ ID NO: 9630 - DNA, 160 bp, Homo sapiens
ccgggcatggtggtgtgagcctgtaatcccagctactcgggaggctgaggcaggagaatcacttgaacctgggaggtggaggttgcagtgagccgagattgcaccactgcactccagtctgggcaacagagcgagactctgtctcaaaaaaaaaaaaaaa

SEQ ID NO: 9631 - DNA, 136 bp, Homo sapiens
taatcccagctactcaggaggctgaggcaggagaatcacgtgaacccaggaggcggaggttgcagtgagccgagatcgcaccactgcactccagcctgggcgacagaatgagactctgtctcaaaaaaaaaaaaaa

SEQ ID NO: 9632 - DNA, 136 bp, Homo sapiens; identical to SEQ ID NO: 9631

SEQ ID NO: 9633 - DNA, 948 bp, Homo sapiens
tgaagtttgatgtcatacatatcatttcattacattactttttattgccaaataattcattatatggatatgtcacattttatttattcataagttgatggaaatttggattgtcccacttcttggttatgaatgttgctacactaaacatttgtggacacatttttgtgtggacatatgtttttatttttctggattatgtactcaggaatggaattgctgccttaatatggcaactctgtttagctttttgaggaactgccaaactgtttaccaaagtggttgtaccattttctgttttgttcagcagtatataaagggtccaatttcttcgcattttggctatcacttgttattacatgtctttctgatgatagtcattgtagtgagtgtgaagtatttcattatggctttgatttttctcagatgactaatgatattgagcatcttttcatatagtttttgatcatttacatatcttctttggagaaatgtctattcaaatcctttgcccatgttttaattgggttatttatcttttaattattgagttgtaagggttctttagatattctagatataattttcttgccagatataatttgcaaatattttctcccattcagagtgttgttttttcacttcattgatcttgtctttgaagcagaaaagtttttaattttgatgaagaagtccaagttatctattttttctttcttttttttatttgtttgtttttttgtgacacagtcttgctctgtcgctgaggctggagtgcagtggcgtgatcttggcttttgcaacctccacctcctgggttaaagcaattcccctgcctcagcctcccaagtagctgggactgcaggtgtgtgccactacacctcgctaatttttgtatttcttttttttttagtagagatagggttttgccatgttgtccaggctggt

SEQ ID NO: 9634 - DNA, 324 bp, Homo sapiens
aaagtactgggattacaggcgtgagccactgtgcccagcccgttgtgtttttggtgtcgtatttaagaaatcattaccaggacgaatatttagctccaagttttattttactttattatttatttatttgtttattttttgaggtggagtcttgctccgactcacactcactggagtgcagtggcatgatctttgctcactgcaacctccacctgcctggttcaagcaattcttctgcctcagcctcccaggtagctggaactacaggtgcatgccaccacacccagccaatttttgtatttctagtattgatggggtttcacc

SEQ ID NO: 9635 - DNA, 21575 bp, Homo sapiens
gttttaagttcttaatggaactttctatgattatagtttgatatatatatataatagaaaattgactaaattcagtcagattttgggttcagttctgcgacctgtgtgatactttgtaatttatcttaatcctcttctgttttccaagattactttctctttctgagtcttctccctgttttccaagattattagtattataagactattattttgtttttgatatgtagcaactaaagatatgagtacttttcagaatttaggggactatggtaatttgagataattatctctgttttctttcttagcctgtggacatctctacagcaatgagtgaacgggcacttgctcagaaaagactcagtgagaatgcatttgatcttgaagccatgagcatgttaaatagagctcaggaaagggtatgtagcagttttttaaaaaaaattattatttaccatcagccaactcacaccaatgtaccagttttaatgtctaaataagaattttgctaactagatggttgagttgtaacatcctttaccttattttcaatgtcttattttaaatgaaagtgattcgaggcctgatcatttattcaataaatgtttattgtttactatgtggcaggaactgtttcttgagagaacaaaatagaaaaatttccctgtcctcacagagtttacaatctggtgtataaaaacaactaagtgcctacaaccctatgaaatgtgtaggtattaatagttgccatatttcagccgagaaaactgaagtaaagggtggttaaggccaggcatggtcgctgatgcctgtaatcccagcactttgggaggccgaggtgggggcaaggagtcaggagttcaagaccagcctggccaaggtgatgaaaccccatctctactaaaaatacaaaaattagctgggtttggtgttgcatgcctgtaatgccagctactcaggaggctgaggcaggagaaatgcttgaacctgggaggcagaggttgcagtgagccaggatcgcgccactgtactccagcctgggcaacagagtgagactgtctaaaaaaaacaaaagagtgattaagtgatatccatagtcacacaactaattagtgggggaactgggattcaaacccaagcaatctgaatctggagtctgtgcttttaacaatggacagcctctccatttcatttctactgttttatggtaaatcagtaagtacatgttcagacaggaaatacattgctgacagtgcaaggtgtttagtaaatctaatttgtgtgaatgacagctgatctttatcacaacaaatgttggtgactgaaaaaaagtatacaagcttctttaaaaagttgttttacggccgggtgcagtggctcacgcctgttatcccagcactttgaaaggccgaggcgggcggatcagttgaggtcaggagttcaagaccagcctgactaacatggagaaaccctgtctcgactaaaaatacaaaattagccgggcgcggtggcgcatgtttgtaatcaatcccagctactctggaggctgaggcaggagaatcgcttgaactcgggaggaggaggttgcagtgagcagacatcgcaccattgcactccagcctgggcaacaagagagaaactccatctcaaaaaaaaatagtcgtttatgtattcaagtggacagtttcctacatttaaactctttaaacctgtgtcatgaatttagtctgtataaatgtctcaaaggaagtaattaagaatccaggctgtcatgacatgtattacaatacatttgtatgagataggaagggagggtggggacccattgtcatatgagctcttttttgcatttttagtgtatctgtgtgatagtttgaagaatattaacagctgtattttttagtagctgtgcttttagatacatttcaaaatcttattaatgggattcactaaatgttgtcaaactgcttctttagaaagtttaggcaaacatttaatgttaaatatgttttaaaagttaaatatttaagtctgcttttcagccatttttagtgaattattaccagtgatgttttaatcaggtaattttacttagttaactgagactacttcttttcttcagattgatgcctgggctcagctgaactctattcctggccagttcacaggaagtacaggagtacaggttttgacacaagaacagttggccaatactggtgcccaagcctggattaaaaaggtacacagtatatgcacatatgaaagtgtcgaacaaaaagtttaaattttttggaaactgtttattaaaactgcatgaaaagaccagtgactctaaccaaagttccaagtaaatttgctatgtgtatatgctccagggcggacactgaagacggactggattcatgagaaaatggcaaatgtataaatgtggctcaagagccactaacttataaggttattttaaaaattgttactgctgcttttgaaggggtgatttaactttattttgaacgctaatagtgtatcaggtgctgttcagaatattccacagttcctgctggactactaacctaatcatttcaaagcagtggttctcaaatttttcttcatcatgggatactttattacaggtttatttttagtggatcactgcccccaagagccctctaccaccttaattttccattcctctattcctttgccctcgcaccccacccgcttcattagtgcctgtgccttcttgtaagatctcttggcccccgttcctcactcctcttgtgacctgtagccccaggaccttttggttgtcagctgctggttacagcaagtggttgggaggccctagtattagctctgcatgtggtgatcttgccatgggactggaagcctgagggaggatggctggagtggggtgggctgtggtgaaggggatgggatggagattaatctgtggaccaccatttaggccctagtggcctctggtgatccacaggctcaatttgagaaccactaatttcatgacaaaacagatatgtaagacctaaaatcaagggagagaatggacgcctcgtgctacgaagatgtaggtgcatctggtttcagattctgcagtgagacctgtgaactccacctacggctgcctcatcattgggggagtcttaggtggctaagaagggcattctgaagaaacgcgttgtggtgaagggacaaagcttggttggatgggtgatgggaaatttgttacaggagtactggcagcatagcagtgctgaaactgggaggccgcgtggtctaatggattgggaaggtttctttatcctgttgtactcctgactccttgtgtaatcatgggcaagtaactctttggaatttcaaagtctctgaggtgtctagtggtaatcagtaacgtgatggttacctatagagagttgctatgagtgccagtgaatgagctgaatttctgaaaaatgagacattggttgctttgtgtattttaatcttgtaacatttatttcaattttgatagctttatctttgttgatcttactaacaaattaatatgaaacatcatgtatactcattatgcctgcctttttttgggaagtagttgcactgatgtgtatagtgagtacacagttagattcattaagaaattacaatttctgcagtttgctgagggttggtgttagaataaagggtgaaaatgtatatagcaaaatattttaaagattggattaatcttggacttctatattatagttactatgaaagtgatttatataatatttgaaaaaatgtctttcatctttggaagaactataaatgtacatctatttctttagttttaattctttaatactatttagtcttgaagctaagtactcagccagtatttcaggaagttagaaataaagcttatgggtgttaaaataggcacataatacagagtcatgtacactgctaggtagaaacttctgaatgtgcttccattacaaaattttggtctttatctaatgatgtgctgatccataatgtttgtatacttataaatgtgttaataacttaaataacttttaaaaagtgaatcttttactgactcaattggttttcccctaaaataatttcttctggtatttgcagtcttgtaggcagttaacagactttaataactttaaaatgtttagtagcaccttgaaaaaaggcttcaactttatattttatgtaagatatactttgggaagcaaattattttgataaattatgagataaagatatgttcagaccaaattttaaattatagataaaagtagcacttaaaggaaaagattcatttgtatagaattactgaagaatatttgatgctagtatcaactaaaaaagaaacttttgaaaattaaaaatgggccacaacatgtagaagtcattaggcagctgaaaatttaggatgtatgatccatgttaaatatcacaaatattgtctactcattaaatgtttagttgtgtttagaaaacctgtcaaacgatcattttggctcttctttagtatagtccagcatctgccttatgtgttaaaaaacacatggaataccaacatcctccgtgttctttttagtttgttgcagtgtatttttagattacaaaaaaagcaaagttttatcagtagtctcattaatcagtaaaacatttaaagtagttcgtttaaaagaaattttatttctagaatggaatgatttggatgtgacctgataaatacagtttgttattgtggtctcattaaattaatcagctttttcacactggggtaaagaaacagatgatgatactagggaatggaaacaaaattggaaacctgggttatttggggatttatattgtactctgcacagttgcccttttttttaggcgtgttccctggaaaagagggacggatgaacctggaagtaagtaaaagacattctaggtgtgtagcatcaaggcagttaatatccaagcatcagctttctctttatacatctacactgcatggcctgcaccaaataaggaactgaaccaggggtatgtttttacctccacagctgcctccttccatcagagcaccttgatgaacttaatgtctagtcacacgtcattggcatgttttctccccagcatttaattacaaagctgggaaacaaaagatgatagatacagttttactactgcatacaaacatttcttttttacattcagtattaacttatcaatataggagatgtgcatactatttcctgagctactgaagtttttttactctctctgttgataagttaatgacttttgctatattatatatttatatatatatatatatatatatttggtaagagaacataaaaacctaaaatttagtaacaaggggaaaataaagcatgatttggagatatgtttcaaatttttaaaaaatgaccataaagatcaacagtacaacttaatactgtttgctatatgtacatggatgccctttaataagaggcattgaatatttcttaacctgtaaaaataactgttgaccatgctaatgtatatatacttgtgcatcttaggacattaagtggtttgctgctttgatggaaattatggttcagtgggttggatacaagagagatgactgttcacagaataacctgtgaactttcacccctctgtatggaaacttgtttcagggccaaatccttgtagctgtcttcttgccccggtcagtgccagccgtactattcacaacactgctgctaccgaggcctaggtatgtaaacatttaaggagttttttaaaagtcttttaacatcaagctaggttttaaaagaattcaaattcattttggcatacttacaggatattttatgtgattgttttctatttgttactgtgtaaatttcaagagtttttttttttttttctgctttagggattttctaagtaaaatatttatacttgctttatagtagaatggggaagaaaactttggatgacaacagtatgcttcttcagtgtctaaactatttctaagtgatttctgggctttattcataaactaggtacacctgggacaattaatatcattgattgttttaacattgccttctttttattttgcaagctaagaagagataccagtgaacctaaatagtggacgaaaacaggagtgttctaattttttttttttgaggggggcacgagggctactgtttcaaaactgccatttacttgtcttatttgacttccaaaatactattacgttaatgtgcaaataatcagaacatacacactacagtatgtataaagtatagaggaatttacatttaattgctataacagatctagaagtaaagtaagattcctctttttagaaagtaaacaatgaatctgtcaccaagttctaactgtaaaatggggacattttacctttctttctttggataggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtaacaagttcttttttggaatgtttattaacgtctcctttaacattacctttaatatatccttttgaacccagtgatactgaactgaaggcacttcttgtatatatacaggtatttgtcagaaaaaacattaaccccttttggggttcacagagcagcttatttttatataactatggatagagacaccagtttgaacttttaaaaggcaccttttgttatgctagttgctaaatatggaaatgtgtatatatctaattttattattacacctccaaattcaactggatttcatgtttagaaaacaggatttccattttattttctcttgacaaggaaccatccttttttctagagtttagtttattttttgttagatattttagcacatcttcattatttcctattacaatactggtttagtctagatttcataaaccctgtttgcttttttcttccaagctcagtagttaagttgggttagagtatagtagaccagctgctgacaataatgttacttcttcctgttgccttgtgttaaggcatcttggaactgttagcattgactgtattttccttttaccttcagatacctgggcagggcagcactgtgtcttctatgtagcttgtatgtagttgctaagtatttaatcattcccacagatgatagctaattggcgtcttttaaataacttcttcccttggaataatgtaagtggaatcatgagaggcttgccagctcagtatgatttttgtatagcttgtttaaacctcatttataaaagctgacaaatgtaaaactgggatttattttcatctttgtaatcaaacagtaagttgaagctaacttcaatagttaaactgtcttaatgaatttggaaatgaactagctctgcaccaaatactttgatgttaagtattgtacaatttcaggaagcattgtccttggaattgtgggacatggcctgactgtaagctctcagagaaccacagatttcccaggataggtttagaaaagcttatattagcatggaattatttagcaaaggttgaaaaatttcctgtaacatacaggatgagcatcccacatctggaaacctgaaatgctttaaaacagaaaactttttgaatactgatatgatgctcaaaggaaatactcattggtgcattttggatttcagcctcttcagatttgggatgcttgaccgctaaatacaatgcaaatatttgaaaacctggaatcaaccgacacacttctggtcccaagcattttggataaggaatactcaacctgtatatgaattgggaaagcagtgtttgggtttagcaatgtagctaatcccctttgtaataagtctatggagagagaggttatgtagaaaggttatgttcatattttgagaacatctcccatttgttaggaagggagaggagagtttgctaggaaaaaagggacctattttatttggagacaaccgttttcacctttttggtggcttaaaatcctaaccttttttggaagagtcttaactgaagcttatttttttaagagacagtaaatctgcagaaatcacttggcaataagctattttttttctttttttgagatggagttttgctcgttgcccaggctgtcagtggcacgatctttactcactgcaaccttcgcttccaggttcaagcgattctcctgccccagcctcccgagtagctgggattacaggcgcgcaccaccacgcccggctaatttttgtttctttagtagagacggggtttcaccatgttggccaggctggtctcagactcttgacctcaggagatccacccgcctcggcctcccaaagtgctgggattacaggcatgagccactgtgcctggccatacttaactttttgttttctgtttacatttggtatttattacaatttctcataccaagatctatgaatattaaatataaatttatatgctgaaaaacagtaaaagagaagaaagagaagattgatagagaaatcgagtgtactaggaatctgctgattttatttgaaggcatacattttgaggttcagactcctacagagggatctttgttttaaagtggtgctttgaaatttatttagtgaacaatttttttttaaaggtcttgttgcagtaggagaaagagcacaaaagaggtctgggaacttctctgctgcaatgaaagatctgtcaggtgagagcacgtttttgaatttcctcttaccctaatcccaccttgaattcattatttgttgcagaagttggtggaaataatttaaaactgggtatttctcccccctgcaggcaaacatcctgtgtctgctttgatggagatctgtaataaaagaaggtggcaaccacctgaatttctattggtccatgatagtggccctgatcatcgcaaacattttctctttagggtaaatatgaatttctgcattaattatatatatttattaatgtgatgacttagagggtgaggggtaaacatgatcacaggattaagattctgttcatgggtggggggtttgtatttgtagttaagtggtggggtttttaaacactgaagggtgctttaatacgacttgtcaatgtcctattttttaaaaaattggaaaagggtaaaatatagtatacaattgttattttctagttgaatgtggggaattaatttaatacttttgtcagtctttttctcaatttggagacctgctctaatttgcagtccctttcccaaatgatttggttcttcgggttgagattataatttgacttacatagtatgggttttatatttttgtaaattatttttctagcatttagtgaaaaaatacaaagctaatagatattaaagtttgatgctgttcttattgtatgtttttcttgaataggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttattttctgggttataaagtgaacaaatacttagatactattatttctttacccaatgcttttgatttttaagcacttttattttaaaaatgtgaattatacagtccccccctacacacacacacacacacacacacacacacacacacacacacacacacacacacacacacacacacacacacacacacacacacacacacacacacacccctataagcacattaaatactactttgccgtgacagctcagtgtacttcacaattcttaacactattctatgtggaatacaaaatgcctttttatctgaattaacatgcatttaaaaagttttagtatatgtgaaaataaaggaattataaatcagtaggaaagatattaaggtagaagcatcaccaatcaactagctcagtagatgttgtctgtatttattttctacctttatgaaacaagaacctgctaacaggtaaatcgtaaagtaacatatttttgccctgatgccattagtcacaatgccatggggtaactgctatgtgatttcccatttgcaaggaagcatattaattcagtttctgctcaatatacaattaggttgtagggatatagatatctcatttgagttatctgagtttttcatctttatatctaaaaatctaatctgaaaatagtaaaacacatttaaaaccttagatgctactgtagtaaaagttatgtttataaacatttcagtatattccttcaacttcaagaatcttgaatttccttgctagaaggcttttttcctcaaagattccttttaggcttactttggtgttcaggatctccaattataaatgtagtctctcagcaccacattccgtaaagatgatttcccaagtaacggtatttgactaagttgctccagagtgttagggtgcaaaccacagttagtaagctccttatgaacaacctcctgtggaaatgtgtgtacaagtcagtaaaaagcacattagtctttaaacacagaagagttaaataattactatggagactgacaaataaatggctgattaatgtgattcatcctattaatagaagttgatgctaagaatttttgtagtgacaaaatcccaaaatattaatggttataagtctagccaactgagatgcatgagacaattttaaaggtcttaattctaactctaaaaaccttaagtatgttcaaaattaaaggcaaatatggttaaatacccacagtgaattgtttccttaaactataaaggaatcaggtactattgagttttggatgcaagaggaaatgaaaaagctgcccctttttggaatgggaagttcttcagtcactgttaaaactatttggactgaggccgggtgccgtggctcaagcctgtaatcccaacattttgggaggccaaggtgggcagatcacctgaagtcaggagttcaagaccagcctggccaacatggtgaaacccccgtctctaataaagatacaaaaaatagccagatgtggtggcacatgcctgtaatctcagctacttgggaggctgaggcaggagaactgtttgaacccaggaggctaaggctgcagtgagccgagactcgcgccgctgcactccagcccgggcaacagcaagactccatctcaaaaaaaaaaaaaaattgtacttggactgaattcatgaaagctacctcacataaacaacttacagacattattccttcctctagtaattcataattaagtaacagtttaattacttgaaacacaatagtgactcagcataaatgactcaatttccctccagctagtttgaggaaactacaactaaaacagtctgctcataggtgtctacttaccatatcaagtactttgtccatttgcaggcagatgttaaatacagcagttggctcgtgtggatacagtactgcagagaaagatccactctgtgaagatttgagcagcatggtcagtgaatgcagagaatgaggcatgataggacctgtaatctccaaactaaattggtctctgtatccagaaagagcttgtgtcttcacattcacactccgtgccttcatgaaaatgtaaagaaaaggaaaattaagatcatctctcaaccttttgcctagccaaaaatatgttcaatatatttccatttggggtttcctctcttttaacaattatggaataaaactatttcccaagacatctaaacaatgttatgtgagtacaaatacttagtaaattttcagcaacctttccatattaagagattttcaggtgaagtatattccagagaataccattttttcatatagtattttatctgatttagtaatacactgtcaatgcagactattggaaaaacaaaaatttaaaatccattcaattttattgctaagatttagcatgtattttgtatttacatatataatttattatgattataatcccagcactttgggaggccaaggtgggcagatcacttgaggtcaggagttcaagaccagcctggccaacatggtgaaacctcgtctctattaaaaatacaaaaaaattagccaggcatggtggtgtgagcctatagtcccagctacttgggaagctaaggcagaagaatcacctgagccccagaggcagaggttgaagaatcgcttgagcccgttaggcagagtttgcagtgagccaaaattgagccactgctctccagcctgggtgacagagcaagactccgtctctaaatagatagatgaatgaatgaatgaatgaatgaatgaatgcagggcggccaggtgcagtggctcatgcctgtaatcccagcactttgggaggccgagggcagatcatgaggtcaggagttcgagaccaccctgaccaacatggtgaaaacccgtctctacaaaaaatacaaaaaaaaaaaaaaattagccaggcgtggtggcacacgcctgggtgagagtgagattccacctcaaaaaaaaaaaaaaaaaaaaaaaaaaaaaaaaaaaaaaaaagcagggcatggcagtcctgtggtccgatactcgagaggctgaggcaggaatttcacttgagcccacatggttgaggctgcagtgagctgtgccactgcactacagcaagaccctgtctccccaaccaaaaaaagaaaataaatgttcgtataatttaaaaagaggccaggagttcaagaccagcctggccaatatggtgaaactccgtctatactaaaaatacaaaaattagctgggcgtggtggtgcccacctgtaaccccagctactcgagaggctgaggcagaagaatcgcttgaaccccagagttggaggctgcagtgagccgagatcgcaccactgcactgcagccggtgacagagtgggactccctcttaaaacaaacaaacaaaaacaaacaagaaaaaaaaaaacaaaaaaaatagctaggcttggtggtgtgtgcttgtaatcccagctactcaagaggctgaggcatggcgcgagaatcacttgaacccgggaggcaggggttgcagtgagttgagatcacgccactgcactccattcagcctggatagcagcgcaagactccatctcgaaaagaaaataaaaaggatttcatataatttatatatttccacataatttctttgatataactgtcttatataatttttgtttctttttttaatgggaggaaagcaaaatgaaaatatgtaccaagtaaaaatgctaggaggtttttttttaaatcaagaatttatcctatcaaagtaaagtacttcttaaaagctaggttatgcagacttttattaccttaagcatttgcattgtggcacctcggaaagcaacaggggacaagagggttggaggaagtcctgcctgtggacctgaggtagcaactaaactcttagagttaatcaaaaaattgagcaatgtaaaggtgttgattccttttaccaacacaacagattcaggtctgtgatccatttgtacttcatgtttctctttacgcctgaagatgacaatcaaggaaattgcaaaagcaaatctcacctaatgtggaaagcagttatcttgattctgaatcacctgagactccttttctccataatgaaatggaaatcctcttgctacctctctttaccgaatcataaggcatatgtttcaatcaaaatgttaacaatctgaatttgctacaaactgacacctaaacctaatttcttctctagtcaaaacacacctattctcccacaatcataattgaacgttttgattaaaaaaggtttaatagttcaccatttgttgatacttaggggcttatttagtattacaatggagaattagttttaatatgacctgaagataatttaagattataatcatataaaactgccaatgttaaacttctcactaacgtcattcaatgaaaattaattctagttaacaacaactgaaaggatacagcttgatagaaagtatgtctggctttttaattttatcttgcacacccatctcttccagccaggaaaaactttcctcttcatcctcatcactgatggcttgctccctaggaaattgctacagttagagtccctatttcacaagctgttcctgtgcaaatctatttcatgagtccataagtcagtggatgatataaagttattttaatcacatactccccatatcccaagcttgttccagatgctgtctccttcttatggccactttcttttattaaaggcagagaaaattcaatacctatatgaggaacaaaaatgtaactgagttgtcatttaaagtatttaacaggcatgctgtacttttagagtgtaaaaaatttgaaatgttagtttttacaaatgatctattaaggcagtagagttttcaagctttcttcacaaacctacaaacatgcataaaacgtattctccttgaaagaggttcgggaaacaacacatacatgtaacactctttcataaatcatattgtattccagttcactttttgaaaaagtactgattgggcccattaagtagatttcatgatccactaatgggtttactcagtttgaaaattttgttattaaaggggtaattggtactatagaagaatttctagaagagtatattcagatagtgactatctggcccaatatgtgttttattttagagatcagagaacactatgtggaaggaacagtttaaatcaggagtccccaacccctggactgtggactggtactggcctgtggcctgttagaaaccgggctgcacagcaggaggtgagcgactgtcgagtgaacattactgcctgagctccatctcctgtcacatcagtggtcgcattagattctcacaggggcacgaatcctactgtgaactgtgcatgtgaggcatctaggttgtgccctccttataagaatgatgatcttgtccgggcgcggtggctcacgcctgtaagcccagcactttgggaggccgaggcgggcggatcacgaggtcaggagatcgagatcgtcctggctaacacggtgaaaccccgtctctactaaaaatacaaaaaattagccgggcatggttgcaggcacctgtagtcccagctactcgggaggctgaggcaggagaatggcctgaacccaggaggcggagcttgcagtgagccgagattgcaccactgcattctagcctgggtgacagagcgagtctccatctcaaaaaaaaaaaaaaaaaaaaaaaaagaatgatcatctgatgtgtaacagtttcatcccgaaaccatcctcctcactgcccatgaaactgatccctagtgccaaaaagtttgcggactgctggattaaataattgtgggggagggaaaaaaagccagaaataaagaaataatatatttcttaatgttgctaatcaactggtaaaaggcattttaaatttaaatagcttttaggccaaaataggtttactatatagtatagtattctcactttaaacctaaacttttaccttcatttctcatagcttctcttaaacctcgagttgttggagatatgagagctgtgattaagtcacttccagctaatcctgctgctcggaacaggacagtaaactgataggtacaaacgtagaaataggggcaaagttttgtcttcagcaaattatatagagaagtaaagctcacagacctatgaagtaaaaaaattttcttaaggtattattaaacatttaatgcaatgtttataattctgaataattcagtttgatacctggtttaaaacacaacacaaatattttagataatggttttaatttttgtggttacgtatgacttagctttaaaggactgaaattggttatgaggactcgctgatgacttctcaatactttaacaaatagtgtataccacttaaacacttattttttctttaaacaaaacttaattgagaattgcctgctgactttctctgagctgctgctaaaaaaggaagcagagactgacaagaagtagcattaaagaattagggctgcgtgtttatatatatatatatatatatatatatatatactttttttttttttttgagacggagtttcgctctgtcgcccaggctggagtgcagtggcgcgatctcggctcactgcaagctctgcctcccaggttcatgccattctcctgcctcagcctcccgagtagctgtgactataggcacccgccaccacaccaggctaattttttttgtatttttagtagagacagggtttcaccgtgttagccaggatggtctcaatctcctgaccttgtgatccgcctgcctcggcctcccaaagtgctgggattacaggcgtgagccaccacacccggcctgcctgtctgtatatatttaaccaacacttatatacattctaccacaattgggtaaagaatgagtaacagctaaaaaaaaaaaaagtaaacagtttatatgttggttattaataggttcagataaaattcacaaggatctagatacccttctgccattaacgtatccagtcacaaatatgatagagaatgctgctaaaataaaattcactattgaattatacaagtttctcttactaatcttaccagtcactcattaaaacatgctgcagggttgcatcatttgaccaaggacttgtctttccagccatttttctatcagctccaatacgagggaacagtggtagccaagacaaagcagggtggagccaatagataaggctctgctggaaggtacaacggagctcagaggagagtttgggatcctaaaatccaaaggtgacagtgggcagtttttgcccattgagaaatagagaattttattaaagacaatctttaccaaacacttaggtctaagaatctttattgctttctataggaaagcattaataattgttataggaacgaaaacatagtttatccttatttgagccagatgtaatggtaagccgtagtatcagaacatttaaacatagatgggaacattttcctgtttctaccatccttaaggacaatgactaccttttttatcatgaggaataggggtgggcatgtgtgtgtaggtaacactacatccaaccctctctccaaaaggctgttttaaaagtagccagtaaacactgatacggcaaatcacaaatcatcctaatctatttattgaaaagatgtataatataccaagacctttttcagggtaatcctttttaacctagtttgagactttaaaaaaatttttttaagatagtctcactctgtcactgaggctagagtacagtggcacaatcagagctcactgcagtcttgacctcctgggcttaaacaatcctcctacctgagcctcccaagtagctgggactacaggcacccaccaccatgctcagctaatttttttttttttttttttttgtagagatggggtctcactacgttactcaggctggtctcaagcaatccccccacctcagcccccaaaatgctgagattacaggcatgggctattgtgcccagcctcctagttttgagttgatgctttaaaataatcaaaatgtatatctctaaaaccattctagaactcacaaactccacaaaattcataaaatttttcttatacaggtaagaaaatctgtaaatccatcagcccttgcaatcccacccaattgcttttcacttctttctttgtattttctttctcaaaaagccttagagaaaaataatttaacaattcttgcctgcaacactgattaatttgcaagacaagtctctaaatgtatgagcagttactcaatctgacttaaaaaaaaaaaaggtatgaaagcaccataagcaccatctgggaaagacaaaacttcctgtctttgtatctttaaatttccaaagaaaaacttaatggaaggcagcatctgctattttgcaaaggagagcatttcacacttaatttgttactttaacacataactattttatttcagagttacctgtatacttttaggcaaagtaacttctgttgccctacaatgctggacaagaccttgagcttcttcctgtgctttcaaatgatctgcccaggtaaagggttgagaagaggtgaaaaggagtcgcgttttaatactccagtccacaggtaactcagtactttttgaggacggaatatcaggctcggagaatgatacatgtgaagtctttagaaaacaaagaatgcaaaaattagtcgagtatcaagaaaaaaccttcaacctaaagattttatcagctaacatgatcactgaaaagtaaaaatcatataagctgtataataaataacatgaaaaatacattacacactgtaaaaaagtctgaaaggagtcacactaaacttttaaccatggttacctatgggaagcgggaatttgttgttgggggtaggggtggtggaggggcagatttcactttttagtttttacagttctttatggtagtatagatgtttgtattgaagtagaaatattccaagtgttaaaacattttggatcttttaagcttctgaaactctgcatccagggctaacaaagcccatatttaagaaacatttcctgacttcaaatatttcccctcaacctgtctgcttcaggtcgacgttctccacaatacaagaatttttttttttttaaattgagacggagtctccctctgtcgcctaggctgagtgaagtggtgtgatctcggctcagtaccaacctctgccgcctaggatcaagcgattctcgtgcctcgtcctcccgagtacctgggactacaggcgtgccccaccacgcctggctaatttttttgtatttttagtcgagacgggggtttcgtcatattggccaggctgttcgcgaactcctgacctcaggtgtgatccgcctgcttcagcctctcaaagtgttgggattacagacatgagccactgtgcccggccaagcattcttttatatcacaataaaatatcagagaagggggaactatcttggatagaccataagaaggtcacttatttacaagagaaactgggtcttggagaactcttctagcctgttcccattaggacaaaccgcatttatcaaactacacagcacaatggtagtagttggggaatggaaacgtgtgtgtgttaggggagaggagcaacgaggttcagtgctatgccacaacctgtggaggtgggccaggagggctggctctgagtgatgaactggagaagtcaactgcccaaagaagagtggtaaaaactgttagagagtaaaagaaaacccccacgtctatcaggcctattttagcgctggctatctttacagtcatcattactgtatcaaaccaactcctttaccttggctgatgcggtattttcatccctggttgagatgatcaagcctctctgtaaaactactttccaagcaaaatgcttctgagaagtataaatgtatttttaaaaataggctcaaatcctatgaaaaaaaagtttatacaaatacacattctaatgatatttaaaaagtattacctgaggtaattcagtaacagttgttctttcaggaaacttctcttcccatagcaaatcattttcttgattagaatctaaaaactgaggttaaatatattctcctttaaaatttaaaggatgctgaagtttgcgttaaatatgtacagagcctcacctggcatacatgtttctcaataaacgcaagtacacctaaattcagaggcaccccatccaatctatgagtttcaacacttcagttttgtgtctgaactttagtatcaaaattgaggggaacagggaccggcgtttcaaaccgaaagatccaaaaggctttgggtaagacagatgctagtgaattctgaccccacgaatcctcgacattcccccatctccagaataatttggagtgcgtgagagaagggaggccctaaatcacgggggaagcagggcttgtcacctgccccatcgaacagcgtccttgcaagatgggggctctcagggtttttcgagctcttttccaagtcacctctaagtcctctccaaggggctcctcgctgccctctggggccccctcactttcctcgggaacgcgtcccgtgagcacagcccgcagcggggtagccaggggagcgctcttcccacaaacccggccttgccagaatcgcggctcccagggcggggtaccctaaggccacgggcggccgaagtcttcgcgcccatttccttgcctcgaacgcgaggactttccatcccccattcacagctggctcaacccacgaaagacaagagccccttggcggccaggctacaagacactcaccgggaccggggcctccggctgctcgcgggccggcccgtcggggggctccgcggcgacccgcggtcggttgtccaggcgggcgaaggggttcctccgagcagcg

SEQ ID NO: 9636 - DNA, 16055 bp, Homo sapiens
atttcttaacctgtaaaaataactgttgaccatgctaatgtatatatacttgtgcatcttaggacattaagtggtttgctgctttgatggaaattatggttcagtgggttggatacaagagagatgactgttcacagaataacctgtgaactttcacccctctgtatggaaacttgtttcagggccaaatccttgtagctgtcttcttgccccggtcagtgccagccgtactattcacaacactgctgctaccgaggcctaggtatgtaaacatttaaggagttttttaaaagtcttttaacatcaagctaggttttaaaagaattcaaattcattttggcatacttacaggatattttatgtgattgttttctatttgttactgtgtaaatttcaagagtttttttttttttttctgctttagggattttctaagtaaaatatttatacttgctttatagtagaatggggaagaaaactttggatgacaacagtatgcttcttcagtgtctaaactatttctaagtgatttctgggctttattcataaactaggtacacctgggacaattaatatcattgattgttttaacattgccttctttttattttgcaagctaagaagagataccagtgaacctaaatagtggacgaaaacaggagtgttctaattttttttttttgaggggggcacgagggctactgtttcaaaactgccatttacttgtcttatttgacttccaaaatactattacgttaatgtgcaaataatcagaacatacacactacagtatgtataaagtatagaggaatttacatttaattgctataacagatctagaagtaaagtaagattcctctttttagaaagtaaacaatgaatctgtcaccaagttctaactgtaaaatggggacattttacctttctttctttggataggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtaacaagttcttttttggaatgtttattaacgtctcctttaacattacctttaatatatccttttgaacccagtgatactgaactgaaggcacttcttgtatatatacaggtatttgtcagaaaaaacattaaccccttttggggttcacagagcagcttatttttatataactatggatagagacaccagtttgaacttttaaaaggcaccttttgttatgctagttgctaaatatggaaatgtgtatatatctaattttattattacacctccaaattcaactggatttcatgtttagaaaacaggatttccattttattttctcttgacaaggaaccatccttttttctagagtttagtttattttttgttagatattttagcacatcttcattatttcctattacaatactggtttagtctagatttcataaaccctgtttgcttttttcttccaagctcagtagttaagttgggttagagtatagtagaccagctgctgacaataatgttacttcttcctgttgccttgtgttaaggcatcttggaactgttagcattgactgtattttccttttaccttcagatacctgggcagggcagcactgtgtcttctatgtagcttgtatgtagttgctaagtatttaatcattcccacagatgatagctaattggcgtcttttaaataacttcttcccttggaataatgtaagtggaatcatgagaggcttgccagctcagtatgatttttgtatagcttgtttaaacctcatttataaaagctgacaaatgtaaaactgggatttattttcatctttgtaatcaaacagtaagttgaagctaacttcaatagttaaactgtcttaatgaatttggaaatgaactagctctgcaccaaatactttgatgttaagtattgtacaatttcaggaagcattgtccttggaattgtgggacatggcctgactgtaagctctcagagaaccacagatttcccaggataggtttagaaaagcttatattagcatggaattatttagcaaaggttgaaaaatttcctgtaacatacaggatgagcatcccacatctggaaacctgaaatgctttaaaacagaaaactttttgaatactgatatgatgctcaaaggaaatactcattggtgcattttggatttcagcctcttcagatttgggatgcttgaccgctaaatacaatgcaaatatttgaaaacctggaatcaaccgacacacttctggtcccaagcattttggataaggaatactcaacctgtatatgaattgggaaagcagtgtttgggtttagcaatgtagctaatcccctttgtaataagtctatggagagagaggttatgtagaaaggttatgttcatattttgagaacatctcccatttgttaggaagggagaggagagtttgctaggaaaaaagggacctattttatttggagacaaccgttttcacctttttggtggcttaaaatcctaaccttttttggaagagtcttaactgaagcttatttttttaagagacagtaaatctgcagaaatcacttggcaataagctattttttttctttttttgagatggagttttgctcgttgcccaggctgtcagtggcacgatctttactcactgcaaccttcgcttccaggttcaagcgattctcctgccccagcctcccgagtagctgggattacaggcgcgcaccaccacgcccggctaatttttgtttctttagtagagacggggtttcaccatgttggccaggctggtctcagactcttgacctcaggagatccacccgcctcggcctcccaaagtgctgggattacaggcatgagccactgtgcctggccatacttaactttttgttttctgtttacatttggtatttattacaatttctcataccaagatctatgaatattaaatataaatttatatgctgaaaaacagtaaaagagaagaaagagaagattgatagagaaatcgagtgtactaggaatctgctgattttatttgaaggcatacattttgaggttcagactcctacagagggatctttgttttaaagtggtgctttgaaatttatttagtgaacaatttttttttaaaggtcttgttgcagtaggagaaagagcacaaaagaggtctgggaacttctctgctgcaatgaaagatctgtcaggtgagagcacgtttttgaatttcctcttaccctaatcccaccttgaattcattatttgttgcagaagttggtggaaataatttaaaactgggtatttctcccccctgcaggcaaacatcctgtgtctgctttgatggagatctgtaataaaagaaggtggcaaccacctgaatttctattggtccatgatagtggccctgatcatcgcaaacattttctctttagggtaaatatgaatttctgcattaattatatatatttattaatgtgatgacttagagggtgaggggtaaacatgatcacaggattaagattctgttcatgggtggggggtttgtatttgtagttaagtggtggggtttttaaacactgaagggtgctttaatacgacttgtcaatgtcctattttttaaaaaattggaaaagggtaaaatatagtatacaattgttattttctagttgaatgtggggaattaatttaatacttttgtcagtctttttctcaatttggagacctgctctaatttgcagtccctttcccaaatgatttggttcttcgggttgagattataatttgacttacatagtatgggttttatatttttgtaaattatttttctagcatttagtgaaaaaatacaaagctaatagatattaaagtttgatgctgttcttattgtatgtttttcttgaataggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttattttctgggttataaagtgaacaaatacttagatactattatttctttacccaatgcttttgatttttaagcacttttattttaaaaatgtgaattatacagtccccccctacacacacacacacacacacacacacacacacacacacacacacacacacacacacacacacacacacacacacacacacacacacacacacacacacccctataagcacattaaatactactttgccgtgacagctcagtgtacttcacaattcttaacactattctatgtggaatacaaaatgcctttttatctgaattaacatgcatttaaaaagttttagtatatgtgaaaataaaggaattataaatcagtaggaaagatattaaggtagaagcatcaccaatcaactagctcagtagatgttgtctgtatttattttctacctttatgaaacaagaacctgctaacaggtaaatcgtaaagtaacatatttttgccctgatgccattagtcacaatgccatggggtaactgctatgtgatttcccatttgcaaggaagcatattaattcagtttctgctcaatatacaattaggttgtagggatatagatatctcatttgagttatctgagtttttcatctttatatctaaaaatctaatctgaaaatagtaaaacacatttaaaaccttagatgctactgtagtaaaagttatgtttataaacatttcagtatattccttcaacttcaagaatcttgaatttccttgctagaaggcttttttcctcaaagattccttttaggcttactttggtgttcaggatctccaattataaatgtagtctctcagcaccacattccgtaaagatgatttcccaagtaacggtatttgactaagttgctccagagtgttagggtgcaaaccacagttagtaagctccttatgaacaacctcctgtggaaatgtgtgtacaagtcagtaaaaagcacattagtctttaaacacagaagagttaaataattactatggagactgacaaataaatggctgattaatgtgattcatcctattaatagaagttgatgctaagaatttttgtagtgacaaaatcccaaaatattaatggttataagtctagccaactgagatgcatgagacaattttaaaggtcttaattctaactctaaaaaccttaagtatgttcaaaattaaaggcaaatatggttaaatacccacagtgaattgtttccttaaactataaaggaatcaggtactattgagttttggatgcaagaggaaatgaaaaagctgcccctttttggaatgggaagttcttcagtcactgttaaaactatttggactgaggccgggtgccgtggctcaagcctgtaatcccaacattttgggaggccaaggtgggcagatcacctgaagtcaggagttcaagaccagcctggccaacatggtgaaacccccgtctctaataaagatacaaaaaatagccagatgtggtggcacatgcctgtaatctcagctacttgggaggctgaggcaggagaactgtttgaacccaggaggctaaggctgcagtgagccgagactcgcgccgctgcactccagcccgggcaacagcaagactccatctcaaaaaaaaaaaaaaattgtacttggactgaattcatgaaagctacctcacataaacaacttacagacattattccttcctctagtaattcataattaagtaacagtttaattacttgaaacacaatagtgactcagcataaatgactcaatttccctccagctagtttgaggaaactacaactaaaacagtctgctcataggtgtctacttaccatatcaagtactttgtccatttgcaggcagatgttaaatacagcagttggctcgtgtggatacagtactgcagagaaagatccactctgtgaagatttgagcagcatggtcagtgaatgcagagaatgaggcatgataggacctgtaatctccaaactaaattggtctctgtatccagaaagagcttgtgtcttcacattcacactccgtgccttcatgaaaatgtaaagaaaaggaaaattaagatcatctctcaaccttttgcctagccaaaaatatgttcaatatatttccatttggggtttcctctcttttaacaattatggaataaaactatttcccaagacatctaaacaatgttatgtgagtacaaatacttagtaaattttcagcaacctttccatattaagagattttcaggtgaagtatattccagagaataccattttttcatatagtattttatctgatttagtaatacactgtcaatgcagactattggaaaaacaaaaatttaaaatccattcaattttattgctaagatttagcatgtattttgtatttacatatataatttattatgattataatcccagcactttgggaggccaaggtgggcagatcacttgaggtcaggagttcaagaccagcctggccaacatggtgaaacctcgtctctattaaaaatacaaaaaaattagccaggcatggtggtgtgagcctatagtcccagctacttgggaagctaaggcagaagaatcacctgagccccagaggcagaggttgaagaatcgcttgagcccgttaggcagagtttgcagtgagccaaaattgagccactgctctccagcctgggtgacagagcaagactccgtctctaaatagatagatgaatgaatgaatgaatgaatgaatgaatgcagggcggccaggtgcagtggctcatgcctgtaatcccagcactttgggaggccgagggcagatcatgaggtcaggagttcgagaccaccctgaccaacatggtgaaaacccgtctctacaaaaaatacaaaaaaaaaaaaaaattagccaggcgtggtggcacacgcctgggtgagagtgagattccacctcaaaaaaaaaaaaaaaaaaaaaaaaaaaaaaaaaaaaaaaaagcagggcatggcagtcctgtggtccgatactcgagaggctgaggcaggaatttcacttgagcccacatggttgaggctgcagtgagctgtgccactgcactacagcaagaccctgtctccccaaccaaaaaaagaaaataaatgttcgtataatttaaaaagaggccaggagttcaagaccagcctggccaatatggtgaaactccgtctatactaaaaatacaaaaattagctgggcgtggtggtgcccacctgtaaccccagctactcgagaggctgaggcagaagaatcgcttgaaccccagagttggaggctgcagtgagccgagatcgcaccactgcactgcagccggtgacagagtgggactccctcttaaaacaaacaaacaaaaacaaacaagaaaaaaaaaaacaaaaaaaatagctaggcttggtggtgtgtgcttgtaatcccagctactcaagaggctgaggcatggcgcgagaatcacttgaacccgggaggcaggggttgcagtgagttgagatcacgccactgcactccattcagcctggatagcagcgcaagactccatctcgaaaagaaaataaaaaggatttcatataatttatatatttccacataatttctttgatataactgtcttatataatttttgtttctttttttaatgggaggaaagcaaaatgaaaatatgtaccaagtaaaaatgctaggaggtttttttttaaatcaagaatttatcctatcaaagtaaagtacttcttaaaagctaggttatgcagacttttattaccttaagcatttgcattgtggcacctcggaaagcaacaggggacaagagggttggaggaagtcctgcctgtggacctgaggtagcaactaaactcttagagttaatcaaaaaattgagcaatgtaaaggtgttgattccttttaccaacacaacagattcaggtctgtgatccatttgtacttcatgtttctctttacgcctgaagatgacaatcaaggaaattgcaaaagcaaatctcacctaatgtggaaagcagttatcttgattctgaatcacctgagactccttttctccataatgaaatggaaatcctcttgctacctctctttaccgaatcataaggcatatgtttcaatcaaaatgttaacaatctgaatttgctacaaactgacacctaaacctaatttcttctctagtcaaaacacacctattctcccacaatcataattgaacgttttgattaaaaaaggtttaatagttcaccatttgttgatacttaggggcttatttagtattacaatggagaattagttttaatatgacctgaagataatttaagattataatcatataaaactgccaatgttaaacttctcactaacgtcattcaatgaaaattaattctagttaacaacaactgaaaggatacagcttgatagaaagtatgtctggctttttaattttatcttgcacacccatctcttccagccaggaaaaactttcctcttcatcctcatcactgatggcttgctccctaggaaattgctacagttagagtccctatttcacaagctgttcctgtgcaaatctatttcatgagtccataagtcagtggatgatataaagttattttaatcacatactccccatatcccaagcttgttccagatgctgtctccttcttatggccactttcttttattaaaggcagagaaaattcaatacctatatgaggaacaaaaatgtaactgagttgtcatttaaagtatttaacaggcatgctgtacttttagagtgtaaaaaatttgaaatgttagtttttacaaatgatctattaaggcagtagagttttcaagctttcttcacaaacctacaaacatgcataaaacgtattctccttgaaagaggttcgggaaacaacacatacatgtaacactctttcataaatcatattgtattccagttcactttttgaaaaagtactgattgggcccattaagtagatttcatgatccactaatgggtttactcagtttgaaaattttgttattaaaggggtaattggtactatagaagaatttctagaagagtatattcagatagtgactatctggcccaatatgtgttttattttagagatcagagaacactatgtggaaggaacagtttaaatcaggagtccccaacccctggactgtggactggtactggcctgtggcctgttagaaaccgggctgcacagcaggaggtgagcgactgtcgagtgaacattactgcctgagctccatctcctgtcacatcagtggtcgcattagattctcacaggggcacgaatcctactgtgaactgtgcatgtgaggcatctaggttgtgccctccttataagaatgatgatcttgtccgggcgcggtggctcacgcctgtaagcccagcactttgggaggccgaggcgggcggatcacgaggtcaggagatcgagatcgtcctggctaacacggtgaaaccccgtctctactaaaaatacaaaaaattagccgggcatggttgcaggcacctgtagtcccagctactcgggaggctgaggcaggagaatggcctgaacccaggaggcggagcttgcagtgagccgagattgcaccactgcattctagcctgggtgacagagcgagtctccatctcaaaaaaaaaaaaaaaaaaaaaaaaagaatgatcatctgatgtgtaacagtttcatcccgaaaccatcctcctcactgcccatgaaactgatccctagtgccaaaaagtttgcggactgctggattaaataattgtgggggagggaaaaaaagccagaaataaagaaataatatatttcttaatgttgctaatcaactggtaaaaggcattttaaatttaaatagcttttaggccaaaataggtttactatatagtatagtattctcactttaaacctaaacttttaccttcatttctcatagcttctcttaaacctcgagttgttggagatatgagagctgtgattaagtcacttccagctaatcctgctgctcggaacaggacagtaaactgataggtacaaacgtagaaataggggcaaagttttgtcttcagcaaattatatagagaagtaaagctcacagacctatgaagtaaaaaaattttcttaaggtattattaaacatttaatgcaatgtttataattctgaataattcagtttgatacctggtttaaaacacaacacaaatattttagataatggttttaatttttgtggttacgtatgacttagctttaaaggactgaaattggttatgaggactcgctgatgacttctcaatactttaacaaatagtgtataccacttaaacacttattttttctttaaacaaaacttaattgagaattgcctgctgactttctctgagctgctgctaaaaaaggaagcagagactgacaagaagtagcattaaagaattagggctgcgtgtttatatatatatatatatatatatatatatatactttttttttttttttgagacggagtttcgctctgtcgcccaggctggagtgcagtggcgcgatctcggctcactgcaagctctgcctcccaggttcatgccattctcctgcctcagcctcccgagtagctgtgactataggcacccgccaccacaccaggctaattttttttgtatttttagtagagacagggtttcaccgtgttagccaggatggtctcaatctcctgaccttgtgatccgcctgcctcggcctcccaaagtgctgggattacaggcgtgagccaccacacccggcctgcctgtctgtatatatttaaccaacacttatatacattctaccacaattgggtaaagaatgagtaacagctaaaaaaaaaaaaagtaaacagtttatatgttggttattaataggttcagataaaattcacaaggatctagatacccttctgccattaacgtatccagtcacaaatatgatagagaatgctgctaaaataaaattcactattgaattatacaagtttctcttactaatcttaccagtcactcattaaaacatgctgcagggttgcatcatttgaccaaggacttgtctttccagccatttttctatcagctccaatacgagggaacagtggtagccaagacaaagcagggtggagccaatagataaggctctgctggaaggtacaacggagctcagaggagagtttgggatcctaaaatccaaaggtgacagtgggcagtttttgcccattgagaaatagagaattttattaaagacaatctttaccaaacacttaggtctaagaatctttattgctttctataggaaagcattaataattgttataggaacgaaaacatagtttatccttatttgagccagatgtaatggtaagccgtagtatcagaacatttaaacatagatgggaacattttcctgtttctaccatccttaaggacaatgactaccttttttatcatgaggaataggggtgggcatgtgtgtgtaggtaacactacatccaaccctctctccaaaaggctgttttaaaagtagccagtaaacactgatacggcaaatcacaaatcatcctaatctatttattgaaaagatgtataatataccaagacctttttcagggtaatcctttttaacctagtttgagactttaaaaaaatttttttaagatagtctcactctgtcactgaggctagagtacagtggcacaatcagagctcactgcagtcttgacctcctgggcttaaacaatcctcctacctgagcctcccaagtagctgggactacaggcacccaccaccatgctcagctaatttttttttttttttttttttgtagagatggggtctcactacgttactcaggctggtctcaagcaatccccccacctcagcccccaaaatgctgagattacaggcatgggctattgtgcccagcctcctagttttgagttgatgctttaaaataatcaaaatgtatatctctaaaaccattctagaactcacaaactccacaaaattcataaaatttttcttatacaggtaagaaaatctgtaaatccatcagcccttgcaatcccacccaattgcttttcacttctttctttgtattttctttctcaaaaagccttagagaaaaataatttaacaattcttgcctgcaacactgattaatttgcaagacaagtctctaaatgtatgagcagttactcaatctgacttaaaaaaaaaaaaggtatgaaagcaccataagcaccatctgggaaagacaaaacttcctgtctttgtatctttaaatttccaaagaaaaacttaatggaaggcagcatctgctattttgcaaaggagagcatttcacacttaatttgttactttaacacataactattttatttcagagttacctgtatacttttaggcaaagtaacttctgttgccctacaatgctggacaagaccttgagcttcttcctgtgctttcaaatgatctgcccaggtaaagggttgagaagaggtgaaaaggagtcgcgttttaatactccagtccacaggtaactcagtactttttgaggacggaatatcaggctcggagaatgatacatgtgaagtctttagaaaacaaagaatgcaaaaattagtcgagtatcaagaaaaaaccttcaacctaaagattttatcagctaacatgatcactgaaaagtaaaaatcatataagctgtataataaataacatgaaaaatacattacacactgtaaaaaagtctgaaaggagtcacactaaacttttaaccatggttacctatgggaagcgggaatttgttgttgggggtaggggtggtggaggggcagatttcactttttagtttttacagttctttatggtagtatagatgtttgtattgaagtagaaatattccaagtgttaaaacattttggatcttttaagcttctgaaactctgcatccagggctaacaaagcccatatttaagaaacatttcctgacttcaaatatttcccctcaacctgtctgcttcaggtcgacgttctccacaatacaagaatttttttttttttaaattgagacggagtctccctctgtcgcctaggctgagtgaagtggtgtgatctcggctcagtaccaacctctgccgcctaggatcaagcgattctcgtgcctcgtcctcccgagtacctgggactacaggcgtgccccaccacgcctggctaatttttttgtatttttagtcgagacgggggtttcgtcatattggccaggctgttcgcgaactcctgacctcaggtgtgatccgcctgcttcagcctctcaaagtgttgggattacagacatgagccactgtgcccggccaagcattcttttatatcacaataaaatatcagagaagggggaactatcttggatagaccataagaaggtcacttatttacaagagaaactgggtcttggagaactcttctagcctgttcccattaggacaaaccgcatttatcaaactacacagcacaatggtagtagttggggaatggaaacgtgtgtgtgttaggggagaggagcaacgaggttcagtgctatgccacaacctgtggaggtgggccaggagggctggctctgagtgatgaactggagaagtcaactgcccaaagaagagtggtaaaaactgttagagagtaaaagaaaacccccacgtctatcaggcctattttagcgctggctatctttacagtcatcattactgtatcaaaccaactcctttaccttggctgatgcggtattttcatccctggttgagatgatcaagcctctctgtaaaactactttccaagcaaaatgcttctgagaagtataaatgtatttttaaaaataggctcaaatcctatgaaaaaaaagtttatacaaatacacattctaatgatatttaaaaagtattacctgaggtaattcagtaacagttgttctttcaggaaacttctcttcccatagcaaatcattttcttgattagaatctaaaaactgaggttaaatatattctcctttaaaatttaaaggatgctgaagtttgcgttaaatatgtacagagcctcacctggcatacatgtttctcaataaacgcaagtacacctaaattcagaggcaccccatccaatctatgagtttcaacacttcagttttgtgtctgaactttagtatcaaaattgaggggaacagggaccggcgtttcaaaccgaaagatccaaaaggctttgggtaagacagatgctagtgaattctgaccccacgaatcctcgacattcccccatctccagaataatttggagtgcgtgagagaagggaggccctaaatcacgggggaagcagggcttgtcacctgccccatcgaacagcgtccttgcaagatgggggctctcagggtttttcgagctcttttccaagtcacctctaagtcctctccaaggggctcctcgctgccctctggggccccctcactttcctcgggaacgcgtcccgtgagcacagcccgcagcggggtagccaggggagcgctcttcccacaaacccggccttgccagaatcgcggctcccagggcggggtaccctaaggccacgggcggccgaagtcttcgcgcccatttccttgcctcgaacgcgaggactttccatcccccattcacagctggctcaacccacgaaagacaagagccccttggcggccaggctacaagacactcaccgggaccggggcctccggctgctcgcgggccggcccgtcggggggctccgcggcgacccgcggtcggttgtccaggcgggcgaaggggttcctccgagcagcg

SEQ ID NO: 9637 - DNA, 16055 bp, Homo sapiens; identical to SEQ ID NO: 9636

SEQ ID NO: 9638 - DNA, 1466 bp, Homo sapiens
ctccatctcaaaaaaaaaaaaaaaaaaaatgaaaccagtagtcaaattactatttggtaatacatttttgacatgaacttgcagctcccttggtaagtctgttgaagagtaaatgaagttttactacctcaggaaaaacatagttgtaattttatttaaatatcaaggttgctataataaaattcctttcagaatcatgagtttaatatgaaacactaagatttgaagagtttcattctggggataaatggtgaggcatttaggttaaacgtttaataaaggctaagagagaagaacattcgcaggtgtaatagtttgctttccacttggaaagaattagttttattctagaagttatattttagagccatctgaatagatgagtagctaatttatagttggaaattagggatcaggagttgggatagtgggtagacacattttccccagtatcctcagattttagccttgttagaataaaagcctattatttatgcctaagcaccctaacacttagatttatagagactgctaggaaaagcaaagtaagtgtgagaaggttaatgagacagtacttgtcgcatcttgtgtgccttcaaaaattaccttgataatcctacctgacaaaacatcttaaggtaggcctagggggacatgaattttcacctgaaatatctgcattctcattaaagtcccaggaatcaaacagacttaagtgaaagatgacatactaagtttcttagtgtttcaatctcactttgcttagattaatatttctaataggtcttagaattgttctaatttgtgtgatgatttacttaaatcaacttagcgaaattacagttgagagattcaatttgaaagatgcattctgcagttgattagactgtttatagatctctagaaagatttatatattaacataaacagtcttaattacagaaaggattaattttgttttcattttaagaaggcattgtatcagaatccatacttaaagaaaaaccttgagttagctaaaggaatattagtttattagcaaggtaactaagaattatggaggattaggggttctgaaggtaagaaagatttgtgaatccttatgcatgagttataattattctcatagtcatacagccttctctactagacaggtcttattcttaagagaagtcttttatacatgatacatagtcttaattacagctagcctctacttgtaaaaaagaaaatccttagccgttagctatttactgacttccccgtatttgttatgttcatgcagtgtctacttattctttgtatatgaaaacagcaaaatcttccatgtcagataagcattttacaaaaatgaattttcttgtgtgagataactaggaaataataataatgttaaaagaaggacaaaaaccaagaaatgagttgataaaaatcaactcgagcttttaattttagaacaaaaaaaa

SEQ ID NO: 9639 - DNA, 218 bp, Homo sapiens
gccaccgcctctgccccccgcagcagggaaagggcgaagaggcagccccgccaccagggcggctcggcgggccgccggctccgtcagctcacggggcggggaggcggcagctccacggctccgggcccttttccgtcggagccgcactacctcgggcggctttcggaagcccggtgagtagccgggcaccgaaagggccatgacgcgcggcggctgag

SEQ ID NO: 9640 - DNA, 218 bp, Homo sapiens; identical to SEQ ID NO: 9639

SEQ ID NO: 9641 - DNA, 218 bp, Homo sapiens; identical to SEQ ID NO: 9639

SEQ ID NO: 9642 - DNA, 147 bp, Homo sapiens
gcacatgcctgtaatcccagctactcaggaggctaaggcaggagaattgcttgaacccaggaggcagaggttgcagtcagccaagatcatgccactgcactccagcctgggctacagagcaagactccatctcaaaaaaaaaaaaaa

SEQ ID NO: 9643 - DNA, 13970 bp, Homo sapiens
aggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactgggtaagtgtggccagcgggctgctctgggacccctccccaggccccctgaccggaagccgctgtcggcctcctggggtctgtgccgacactcactgccgcctcgtccctgccacttctcccgggcatcttggaatctcatcactaacgcagtcccctctgtcctgctcaccagctcccgccctcatccaccacagtctcctccccacagcagccaccagagggcgcctgtgaccacctgagtcagaacccgtccctctgcccacagccctccatggaccccacctcccctggggtcaaagcccaagtcctcgtcacagcccacaaggtcctgcacaacctcccctgtcctctccccgccctcctcctcttcccccttcgccactccgctcctgcataaatacgtgactaaacttgagatctcactgaactgtgacaacaatgctggtgttcccgccaggccagacatcccactccagtcatctcggtcacatattcgcactccctgcactgtttatttgatattcttctttaattaatttatttatttatttagagacagagtctcgccctgtcacctaggctggagtgcaatggcgtgatctcagctcactgcaacctctgcctcctgggttcaagcgagtctcctgcctcatcctcctgagtagctgggattacaggcacctgccaccacacagctaattttttgtatttttagtagaaacggggtttcactatgttggccaggctggtctcgaactcctgaccttgtgatctgcccacctcggcctccccaagtactgggattacaggtgtgagccaccatgcccggcccttttttatttatttgttttagagatagagtctcactctcttgcccaggctgaagtgcagtggtgcgatcatagctcaatgcagcctccaactcctgggttgaggcgagcctcccatctcagcctccgagtagctgggactacaagcacacaccatcacgcccaactaatttttctttatttaatttttggtaaagacggggtctccctctgtcatcccagctgatccagaactccttggctggagtgatcctactgctttagccccccaaagtgcggggattgggatttttgcaaataagtagcttaggatataggcagggcgcggtggctcagcctgtaatcccagcactttggtgggccgaggtgggcagatcacctgaagtcaagagtttgagacaagcctggccaacatggtgaaacccggtctctactaaaaatacaaaaattaggccgggcacggtgggtcacgcctgtaatcccagcactttgggaggccaaggccgggcggatcacaggttcaggagatcgagaccatcctggctaacacagtgaaaccccatctctactaaaaaaaaaaaaaaaaaaaaaaaaaaaattagccgggcgtggtggcgggtgcctgtagtcccagctactcgggagactgaggcaggagaatggcatgaacctgggaggcggagcttgcagtgagccgagatcatgccactccactccagcctgggcaatagagctagacgccgtctcaaaaaaataataataataaaataaacattagccaggtgcggtggcaggcgtctgtaatcccagctacttgggaggcagaggttgcagtgagccaagattgggccgctgcactccagcctgggcgacagagtgagactccatctcaaaaaaaaaaaagcatgggtacagtaggagcaggattaaataaatacatgcagctgggcgcagtggctcatggctgtaatcccagtactttgggaggctgaggcgggtggaggttgaggtcgggagttcgagacaagcctgaccaacataaagaaaccctatctctactaaaaatacaaaattagccaggcatggtggcgcatccctgtaatcccagctaactcgggaggctgaggcaagagaatggcttgaatctgggaggcagagcttgtggtgagccaagactgcgccattgcactccagcccaggcaacaagagtgaaactccatctcaaaaaaaataaaggccaggtgtggtgactcatgcctgtaatcccagcactttcggaggctgaggcagctggatcacatggtcaggagtttgagaccagcctggccaacatggtgaaaccccatctctactaaaaatacaaaaattagccaagcatggtggcacattcctgtaatcccagctactcaggaggctaaggcaggagaatcacttgaacccgggaggcggaggttgcagtgagccgagatcatgccattgcactccagcctgggcaacagagtgagactctgtctcaaaaaaataaataaataaataaataagtaaataaatacatgcatatacacatatgaacctacgaacatgggatgaggccaggcgtggtggctcacacctgtcatcccagcactttggtgggaggattagttaagcccagtagttccagaccagcctggacaacatagaccccatctctacaaaaaatttaaaaattagctgggtgtgctagtgcacgcctgtagtcccagttgctatttgggagctgagacaggaggatcacttgagcctgggagttcaaggctacagtgagctatgattgcaccgctgcactccagcctgggcaacagagcgagactgtacttcaaaatataaaaaccgacaaaacaaacagatctaaacatagaaaaggtacaggaagccaggtgcaatggctcacacctgtaaacctagcactttgggagtctgaggcgagcagattgcttgagtccaggatttcaagaccagcctgggcaacatagtgagaccccattcctacaaaaagtacaaaaattagccaggtgtcttgccgtagtcccagctttatgtagtcccagctactcgggaggccaaggttgaaggatagcttgaagctgggaggttgagcctgcagtaagctgaggtcgtgccactgtactccagcctgggcaacagaccgagaccctgtctaaaaaaaagaagaaaaagtacaggaaaaatacggtatatatggtattataatcttatgggaccactgtagtatatgcagtccattgttggctgaaatgtcattattctcttttttttttgagacggagtctcactctcacccaggctggagtgcagtggtgtgatcttggctcactgcagcctccacctcccgggttcaagcgattctcctgcctcagcctcctaagtagctgagattacaggctagtgccatcacgcctggctaatttttgtatttttagtagagatggggtagtgccatgttggccaggctagtcttgaactcctgacctcaagtgatctgcccgccttggcctcccaaagggctggcattactggcatgagccactgcacccggcctacggtattataatcttatgggacctctgtagtatatgtgatgtattgctggctggaatgctgttattctctgcaggactgcataatgaacattcaggcctatattcacaggttgtccaaggcaggtctggcctgcaggccatagcttgagaccctcctgctagtctaaggtctctgattcctgtgaggtttaattttccttatccccgttttgcagatagggaaaaccaaggcagaatcctttgctcccaggccttcgaggtttataagaagtagaactgggttataaactggacagcatggccaggtgtggtggctcacgcctataatcacagcacttttggaggccagttcggatgaatcactggagatcaggagttcgagaccagcctggccaacatggtgaaaccccgtctctactaaaaatacaaaaattagctgggcatggtggcgggcgcctgtaatctcagttactcgggaggctgaggcaggataatcacttgaacccgggaggcagaggttgcagtgagccgagatgacaccactgcactccaacctgggcgacagagcgagactccatctctaaataaataaataaataaactggacagtgtgattcttgggactgtctgcatgggacgagcccagctgtgtgttctggtcttcacagagacccttctccttttccttgcagcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctggtgaggttccagggggtcggggccctgagccagcagccttcaccccgcagcagacacccacccagagctcagtggcttattgctcacccctctgcaggctggcagggccattcccgcttgctcctggcactgtatctggttgtacactcatttgctcaggatgctgccacaaaccacactgtctggggccgggcacagtggctcacacctctttgtgtgagtccctcaagtgctttgggagcccaaggcaggaggatcgcatgagtccaggggtttgagacccacctgggcaatatagcaagaccccatctctacaaaaaataatttaaaacaattagctggctgtggtggtgcgtgcctgtaatctcagctacttgggaggctgaggtgggacgattgcttgagcccaggagttggaggctgcagtgagctatgattgtgccactgcactgcagcctagtcaacagagcaagaccccatctcaaaaaaaaaaaaaaaatcgtggccaggtgcggtggctcatgcctgtaatcccagcactttgggaggctgaggcgggtggatcacgaggtcaggagttcaagaccagcctggccaacatggtgaaaccccatctctactaaaaatacaaaaattagccaggtacaatggcaggcacctgtaatcccagctactcaggaggctgaggcaggagaatcgcttgaacccgggcggcagagattgcagtgagccgagatcatgctactgctctccagcctgggtgacaagagtgagactccatctcaaaaaaaaaaaaaaaaaattcgtactgtctgggaaatgtaaacaacagatatttattttctcacatttctggaggctggaagtccaagatcagagtgtccttctggggcctctctccttgactcgtagacagccatcttctctctgtgtattcacgtggtcgtcccttccctctgtgtatgtctgtgtcctaatctcttttttttctttgaacggagtctcgctctgttgcccaggcgggagtgtagtggtgcaatctcagatcactgcaacctccacttcccgggttcaagtgattcttgggcctccacgtcccgagtagctgggatcacaggcacttgccaccatgcctggctaatttttgtatttttagtagagatggggtttcactatgttggccgggctggtctcaaactcctgacctcaagtgatccacccacctcagcctcccaaagtgctgggattacagacacgagccaccacgcacagctctaatctccttattgaaggagaccagccctttatggattggagcccaccctaatggatagcttcatttacctttatgacgatttttttttttttttttccagagacaggggctcactctgttgcccaggctggagtggatgatcatggctcactgcagcctcttaggtgcacccatcttggagcatatgtctgccatcattcctctttatttatttttcttttctttttgtggcgcgatctcagctcactgcaagctccgcctcctgggttcatgccattctcctgcctcagccttctggtagctgggactacaggcgccggccaccatgcctggctaattttcttttctatttttagtagagatggggtttcacagtgttagccaggatggtcttgatctcctgacctcttgatccgcccgcctcggcctcccaaagtgctggaattacaggcgtgagccaccgcgcccggcctttttttttttttttttgagacggagtctcgctctgtcacccaggctggagtgcagtggcatgcagtctctgctcactgcaagctctgcctccttggttcacaccattctcttgcctcagcctcccgagtagctgggactacaggcgcccaccaccacgctgggctaattttttgtatttttagtagagatggggtttcaccgtgttagccaggatggtctcgatctcctcacctcgtgatccacccgcctcggcctcccaaagtgctgggattacaggtgtgagccactgcgctcggccgactatttttcttttctcttaaactttatgtaatatgtagagatgagatgtcactgtgttgcctatgctgttctggagctactgagctcaactgatccaacccccttggcctcccaaagcgctgggattgcagaagtcagcctgcttcgttcctttggaaggctgagtcatatttcattacaagcacttttttttgttttttgttttttgttgttttgagatagagtctggctctgtcacccaggctggagtgcagtggcgcaatctcagctcactgcaacctccgcctcccaggttcaagcgattctcgtgcctcagcctcctgagtagctgggactacagatgtgcaccaccacacctggctaatttttgtatttttagtagagacggggtttcaccatgttggttaggctggtctcgaactcctgaactcaggtgatccacccacctcaacctcccaaagtgctgggattacaggtgtgagccaccatgcccagcctacaagcactttttaagcctttgctggttccatctgctcatgtcccattggccaaagccagccacgtgtccaggctcccttgcaagcgcaggagaaattgacacaatgggaagagctacaggggatgtgcagcccttctttgcaccaaccacacagagcctgagtatgtcaatgattaaaccaaaggccccagagctcaccgtagccaggaaacccttcctccctccctccctttctcttttctagactgtcatgtaagtcagatgctggaaggattccttgggttccttctggaatcccgtctctcccaggggagcctccttccctcacttctctctcccctgccccagatggaaactgtcaagcaaggcgttgatcagaagctggtggaaggccaggagaagctgcaccagatgtggctcagctggaaccagaagcagctccagggccccgagaaggagccgcccaagccagaggtacccatgaggggactggggggtggcctagggtacttggagtcccgatgccactctctacacctctgcttcatgggcctacctgcttcgaatgatttccctagcctcacctgcttttggaagctaatgacacctccttcaggaagcctgccttgatttctcctcttgggcatgcataggtatggcttctgttttttgttttgagatggagtgttgctctgtcacccaggctggagtacaatggcatgatcttggctcactgcaacctccacctcctgggttcgagtgattctcctgcctcagcctccctagtagctgggattacaggcgctcaccaccacgcctggctaatttttttgtatttttagtagagacagggtttcaccatgttggccaggctggtcttgaactcctgacctcaagtgatccgccctgcccagcctcccaaagtgttgggattacaagcgtgagctactgagcccggcccctagcagcaacttctgactagtattctccggccccctccactctatctcaagccttggcctcttgtgttctctaatgggtctcgctgcctgtcccaccacccacttaagctccccaggggcaaaggaagtttgcagtgagccgagatcgcaccactgcactccagcctgggcaacagaaggagattctgtctcaaaaaacagaaaatgtcctgaaattagatgaaggtagtatttgcccaaccttgtgaatgtattaaaaaccaatgaatcgtacacttcaaagggcgagttttagggtgtgtggattatatatcaatttttgaaatagttgtttatttatctttgagacagggtctcactctgttgccctggctggagtgcagtgatgccatcacaggtcactgtggcctcgccattgcaggctcaggcaatcctctcgcctcagcctcccaagtagctgggaacacaggcgtgtgccacgatgcctggctaattttttttttaatttttagtagagacaggatctcactgtgttgcccaggctggtcttgagctcctggtgtcaagcaatactcccacttcagccttccaaagcactgggattacaggcatgagccaccacacccgaccccagatcaattatttatttatttatttatttatttattttttgagatggagtctcgctctgtcacccaggctggagtgcagtggtgtaatctcagctcactaccagctctgcctcccaggttcacgccattctcctgcctcagcctcccgagtatctgggactacaggcgcccgccaccaggcccagctaattttttttgtatttttagtagagacgcgatttcaccgtgttacccgggatggtcttgatctgctgaccttgtgatccgcccgcctcggcctcccaaagtgctgggattacaggcgtgagccaccgcaccctgcctatttatttatttattgctctgttgcccaggctggagtgcagtggcacaatctcagctcactgcaacctctgcctcctgggttcaagtggttctcctgtctccacctccccagtagatgggattacaggcatgcgtcaccacgcccggctaatttttgtactttttagtagacacggggtttcgccatgttggccaggctggtctcaaactcctgaccgcaggtgatccgcccacatcggcctcccaaagtgctggtattacaggcgtgagccaccgtgcccggacccagatcgattttttaaaaactgaaatgagatcatatcaaaagcacatagtaagggctacaaaagtgacatgcataaagatatggtgaatatctctataaatgcaaattgttcgggaggcagaactagaccacctgctgcctaaaactgtctcctgtttccccgactgctaagcacagcagccagaatgacttttcaaatgaaaaaaccagatcttatctctctcacgtgggcactctcccgtaatccctcgctcaagtccagagtcctccagctgccagggctctgggcaaaaccctacctcccagtgtgtgccttttttttttttttttttttttttgagatagagtctcactctgtcaccctggctggagtgcaatgtcatgatctcggctcactgcaacctctgcctcccgggttcaagcgattctcctgcctcagcctcccgagtagctgagactacaggcacctgccaccacgcccagctaatttgatttatttatttatttttgagacagagtctcactccgtcacccaagctggagtgcagtggcgtgatcttgactcactgcagcctccacctcctgggttcaagcaattttcctgcctcagtctcccaagtagctgggattacaggcgcctgcaaccacacccagctaatttttttgtatttttagtagagacagggttctgtcatgtttgccaggctggtctagaactcctaacctcaagttatccacccgtcttggccccccaaagtgctgggattacaggcctgacccactgcgcccggcctaatttttgtatttttagtagagatggggtctcaccatgttggccaggctggtctcgaaccctgtctgtgctcatctcactctctggccaaggaaattttcaaggacctgatttcaactatgttctccccggatggtttacaacttctgcctagaaagttcttccaggctgtcccagcctggcttccactttttgttttttaacagcttttttttttcttttttttttttttttttttttgagatggagtctcgctctgtcgcccaggctggagtgcagtgacgcgatttcggctcactgcaagctccgcctcccggattcacgccattctcctgcctcagcctcctaagtaactaggactacaggctcccgccaccatgcccagctaatttttttgtgtttttttagtagagatggggtttcaccatgttagccaggatggtcccgatcgtcctgacctcatgatccaccctcctcggcctcccaaagtgctggggattacaggggtgagccaccgcacccagccttttttttttttttaacagttttattgagatctcatttgcataccatacaagtcacgcatttaaagcatacacatcgctggttctcagcattgtgcaactatccctatctcatctcatgcccctaaaaagaaacccttttcccatcagcagtcactgccccatttcctcctcctcccaaccacgtatcccctcctgtctctggatgggcctgtcctggacatttcatagaaatgggatcacaccctgtttggccttttgtgtccggcttctcgcgctgagcgtgacgtccttagggctcacccatgctgtggcctgggtcagagccccatgacgttccatggctgagtcacattctgttgtatgggtggatcacattctgttcacccatttatcaaccgaaggacacttgagtcgtttctactttttgctgtgcccctgtgtgcatgtctttgtgtgtggacgtatgtttccgtttctcttgtgcacacacccacaactagaattgccgagtcatatgatgattctatggtttaacattttgagtaaccgctagactgttttccaaagtaactataccaccagcaatacacgaggcttccaatttctccgcctcttgactgacagtgggtatcatctgatagcctctggggtttttgtttgtttgtttgtttttgagacagagtctcgctctgttgcccaggctggagtgcaatggcatgatcttggctcactgcaacctccgcctcctgggtgcaagcagttcttctgcctcagcttcctgtgtagctgggattataggcacatgccaccacacccggctaattttgtatctttagtagaaatgcgggtttcgccatgttggtcaggctgaactcctgacctcggtgatccacgcaccttggcctcccaaagtgctgggattacaggcatgagccaccatgccaggcctccttatggttttgatttgcatttcctcaatgacttataaggtcaaacagcttttcatgtgctctccctatatcttctttggtgatttgtctatgccctttaaagaatttgactagtggccaaatgcagtggctcgtgcctgtaattccagcattttgggaggctgaagtgggcaggtcacttgggcccaggagtttaagacctgggcaacttagtgagatcctggctctacagaaaattttaaaaatgtagctgggcgtggtagtgagtgcctgtagtcaggcaggctgaaatgagaggataacttgagctcaggagttacaggctgtagtaagctatgatcacgccactgcactccagcctgggcgacaaagtgagatcctgtttctaattaaaagaaaagagtctgggcgcggtggttcatgcctgtaatctcagtactttgggaggccaaggagggccgatcacttgaggtagagttcaagaccagcctggccaacatggtgaaaccccatctgtactaaaaatgcaaaagttagacgggcgtggtggcacgcgcctgtagtcctagctattcgggaggctgaggtaggagaatcgcttgaacctgggaggcggaggttgcagtgagccaaaatcatgccactgcacgccaacctgggcaacagagcaagactctatctcaaaaaaaaaaaaaaaaaaaagggccgggcacggtggctcacgcttgtaatcccagcattttgggaggccaaggcaggcggatcacgaggtcaggagatcaagaccatcctggctaacacggtgaaaccccgtctctactaaaaatacaaaaaattagcctggcgtggtggtgggcgcctgtagtcccagctactcgggaggctgaggcaggagaatggcgcgaacctgagaggcggagcttgcagtgagttgagattgtgccactgcactccagcctgggcgacagggcgagactccgtctcaaaaaaaaaaaaaaaagtttcgcctatggaaagcgtttgccccaaggtcagtggtagaacccctcttcccctctttccctggcttcagctccgatcgcctttcctgaaacaaatggtcctgattggtgtccccatctcccttctcagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggc

SEQ ID NO: 9644 - DNA, 3921 bp, Homo sapiens
cccccagaggtcatgctgaaagtacgtctaatagacaggtaagtatgtttatattttactcttaaccatttcgtttttaaattataaacaataaaaattcagagttatgtagatttgcaatggccagtaccttccaagaaaatccaagaaaataaataattcaagggaggcaagcttactgactacaccctatggggactaaagcagccttgccgaattctatccgaaatcaccaacttgtttgaaaaaagtttattatttgaactttcatttattaagaaaaatttctgagtttccttgtttggtagatcttttttttttttttttttttttttttttttttaagagaaggggttctgccatgttgcccaggctagtttcgaactcacaggctcaagcaatccacctgggattacaggcatgcgccaccgtacccggctgaattttttcaagcaattgtctgagtgtttgtaatttggttcctccattttgtcagggaggttgcaggaacaggaggcatcctgcataagcaggtgcatttctgcttcttttggggtcccagcaagacaagtgttgggctccaaaaggggctttcggctcctgctgtgtgttcacaaacatgtgttgtgtttctggctctccctctcaatttgcaagtaaaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 9645 - DNA, 5958 bp, Homo sapiens
ttcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccgtgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtttggtaagaagtattaatgaagtagctaatattacagcttcattttctactaccacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaccacattgtgtttatctgagtaagttcattgggatacagtcaatacttgtgctgttaatgtagaagaaatgacgcaggagggcaggaataaaagaggtaataggactttcgtattctcctatcatgaatatgacttgcatttctaaaggccatttgatcctttttgtgtgaggagtttatatgaaatcctcatgttcttttaaatttcccaactaaattgtgtgttcctacgaataccttttaggtatgcacacatacacagagcatcttattttatactggtgaaatctatgttgtttaggatacagataatgtcattgtatttatcctatcagaataggcttttcccctatttcaaaatagatgctattggctttattttttatttttaaattttttttaaacacggtcttaccatgttgcccaggctggtctcaaactcctagatgcaagcaatcatcccacctcgatcacccaaagtgctgggagtacaggcagaggacaccatgcccagccacgctattggttttaaatgtcagatttctttaagaattctcatagtacttttctgccgcagaatttatagcacatctgtccatcctttcaataggcactcaaggaaatgtatctattcatatgctcaacttcaattgattagtctcatatgatttttcagaaccccttttgctaacccctcttggccatttcattaataatgtatttgacagagattgaatcaggaaataaattcatgacatttcagttaactagtattacctgtttgtagaatctctgttggaacattgactatgaaagacagtgctaacaagtaattcatattacttttggggattttatgtaaagtaacatctatgctattcttgggtacttttgccaagagttacagaccttattctatacagactaaaccattagtcaaaaaataccattcattcaaaataattcattaatgtcctcctactctgttccaaacactaggctgagttcagaggcctcacagaatagtgaaatgcgttcttagccaaatcaggcaaatcttctccctcactatgtccctgaagaaatctcttcatctgatatatttactattcatctactttctacagcactatgttagggtcttccggggattcagagaaaagtgtctgtgagccattaagaaactcacagatcaggtaataaacactttttctaatgcattccagtgtctcagagcctgcataatcactttatactacttcattaaattgacaggacatctaaggtgacaaaagagatgtttctacctgttggtaaggttgatgcaactgtcataattagatgttcttggtttttaatagatgcagcaatgagagagtacattgctaaagtcagaacttaatttgaattaaattttcaagtttccaccaagtatttgaaaacttagaaattgtatttcgtaattacacatgcagacatttaaatttttattaagcaccacgatggaactcaatctaaaggaataatggcacctgataattactaacaacctttgtttatataagaccttgtgcaaactgtgtgataacgtatgtttgcattctgtctttaaaataaccctgtaaggtgcgttattttaatttttagattttaaaacttagcttcaagagaaattaagtgattagtctatagctacaaatcctgtaaatggcagagtcaggaattaccactgagcatgactccatggactcttaattgttttcctgcctcttaataaattgaccatccttgagactgactagccttcagatttttcatgatggagctatcataacttctcagtggatacatatattatcatttatggcaaataaagggaacattttagaagcctc

SEQ ID NO: 9646 - DNA, 2545 bp, Homo sapiens
ttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtac

SEQ ID NO: 9647 - DNA, 13862 bp, Homo sapiens
ttcagaaccaggagaggaagcacaggacgtatgtctatgtgctcattgtcactgaagtgctggaagactgggaagattcagttaacattggtaagccatctccagacagcctggaaagggttcctcacaaccagcccttgccatgccacaggtcatgaccagaaccagaaacaagagcgtaccaggctcagtggctcacacctataaccccagtactttggaaggccaacacaggaggatcacctgagcccagagttctagaccagtcttggcaacctagtaagacctcatctctacaaaaatcagaagacttagctcggcgtggtggcacatgcctgtggtcgcagcttctcaggaggctgaagcaggaagatcatttgtgcttgggagtttgaggtcacattgagccataatcatgccactgcactccagcctaggcaacagagtgagactctgtctcaaaaacaaacaaaaaaacagaacaacaagagctggataaagaatagaaataattgaaggatgtgtataataaaacaagcatgtacattttgaacctgatagtattttgaaatgtttaaatggaatctgaagtgagtacatggtccacaaatagaagcatgacccctaaaaataagaaatgttgcttctaaaatcaaactgggtccttgccaaaagggctatacttctgcacctcctgagcagatactgattgagggcctccgccatgccaggctcactgctggccatggggaccataagtgagagcaggaccctggtcttgttcctcatgacatttatattgttgagaaaactgttggtttggtggtgtgagtccctccagaaatcatttagtagatacagaatagtgcaggtggtttctagttttattcttataaaatatgaatatatctataatatatatttttatattttttcatattttatatgaatataaaaatgataaaatttatgaacttttacaaaaggtgctgtgtgtaccctttaggtacacccaactttctcccaaaggagccattttctttgatctcagatggctgttacgtttacatctttggaactataaactgtggtggtacaaaggttggttcatggtttgattgtttacttctgaaggaaagtatattctagaaaggagaacactaatttccattacaaattggcagacagataaaatttatttgccaacattctcactttaatgttagtgtttgccttgccgccatgcccctcacattgttactctgggcagttcgtagccctttggctcttgatggctttgtgtctagtaataatgcagggtgctcaaggaaataaattcagtgtggatatactgaaaacagactccctaacaggtgtgctagagcttgaaaaggagactgcggtggatgtgtggtgtggccctatcctcagagcactctctgtcaggcaggagtcatacacttgtgatactaatttttttaggtaccattgctctattaatattcaaacaagcctttcaccttgtactcccacttctgagaattgaccctaatgaaataatctaaaatatgacaagctatggagccttccttcagatgatcttactaccattattcttactggttaaaatttgcatcttaaatatataactcaatgaatgacaaatcaatgaatgacatgtgtccgatggaatgttatacagctgttaaacaccatagtttaacaccaccctgttaaactgcagttgcagtggctcacgcctgtaatcccagcgctttgggaggctgaggcaggcgaatcacttgaggtcaggagttcgagaccagcctggccaacatggtgaaaccccatctctactaaaaatacaaaaattagccaggcatggtggcacacacctgtaatttcagctactcaggaagctgaggcaggagaataacttgaacctaggaggtggaggttgcagtgagccaagaatacaccaatgcactccagcctgggcaacagataagactgtttcaaaaaaaaaaatttttgtcaatgttaaagaaaagctaatattggcaggaatgtggtgagactgacatcctgacatacacaagcaggactggggatcagtgtcgcctttctgtaaagcacttttgcagtataaatcaggagcccttgaaagttcagaagctctatttttgtagttcttgtgctagatatctttccctagaaggttaaaaagaaagaaaaaacggggaacgttttaaaaaaatagcattatttataataattaaaatcactgggcatggtggatcacgtttgtaatcccagcactttgggaggccaaggcgggtgaatcacttgaggtcaggagttcgagaccagcctgtccaacatgctgaaaccccatctctactaaaaatacaaaaattagctgggcgtggtggtgtgcacctgtagtcccagctacttgggggctgaggcaggagaattgcttgaacccgggaggcggagattgcagtgagctaagataacgccactgcactccagcctgcatgacggagtgagcctccgtctcaataaataaacaaaaattagctgggtgtggttgtgggcgcctgtaatcccagctacttgagaggctgagccatgagaattgcttgagcctgggaggcagaggttgcagtgagccgggatcacatcgctgtactccagcctgggtgacagactgagactctgtctcaataataataataataataatcacagacaattgatgtccagtgatatggaaatgcttaagtgaatgataatacatccatactagatactatgacataatgcagccataaatgtcttaaaaaaaaagacagtctcactctgttgtccagactggagtacagtggcatgatcacagctcactgcagcctcaacctcctgggttcaagcagtcctcctgccttagcctttctagcaatggcaatgtctcatatttttttcataatatagattgcttaagaaatagtgtgacataggacaggtgtggtggctcatgcctgtaattccaagtactttgggaggctaaggcaggaggatcacttgaggccaggaatttgagacctcatttataccaaaaaaaaaaaaaaaaaaaagaagcagcagcaggtgtggcacgtgcttgtagtcctagctacttggaaggctggggcaggaagatccctcgtgttcgggagcttgagtttgcagtgaactatgatcataccactgcaatccagcctgtgagatcctatctctggaaaaaaaaaaaagagagaaagaaaaagaaaagaaaaaataacatgaagtaaaaaccagtaacaaaaattaaaaagcaaattcagcagcacattcttttagcagccagttactcttcaggtgctttccatactaatagtcataacagacttgtgagataggccctatttattgtctgttttatagatgaggaaaatggagcaggaacacagctacctgaggctgcacagctcattggagccatttatgtgattggagcccagcactttggcttcagagtccttgttcctgaccataacactctagcagagctggtcaggattcagagtacctgaaagcatgatccaattttggttgtctcaagattgtttctttttcaagtatatgaaaaaagggcagttgtgctagggtattgagagtggttttttctggtttataagattatgggtagttattacttttataagataaaaaatataaaggattttaaagcatggactagaaaagagtaagaaaatagactgaaaaataaaagtgtgattgtattgagattatttttacttcttttaagaaatattttctattatgtagataaattcactcttataagaaaacttttaaatgaattactgattacaaaccagccatcctagtaattctggaagctgatgctcgtgttgatttttccccccttgggacagggtctcactctgtcaccctgctggagtgcagtggcgcgatgacagctcactgcagccgcgaccttccgggctcaggtgatcctcccacctcagcctcctgggtagctgggagtacaggcacatgctaccatgcccagctaatttttgtattttttgtagagacagagttttgccatgttgctcaggccagtctcaaactcctgggctcaagcgatccgcccaccttagcctcctaaagtgctgggattgtaggcgtgagccacctcatccggccctcatgtcagtttttacaggagatggggatgctgctgggctttgatccctatgtatgtgcaagcaaggaaagctcagagacgcaggagggcaggaggaaaacactagccgtagttctctctggagggcaggttttacacaattactcttagctctttggttttcaggtttctcacctttctgcattagacattgatataatatttgaagcatatgaagtgtgcttgagttatttttgtaaggaaaaaaagtgttaagaaacattgctttaatgttttctatattttctcaaaagttctaggctcagaaaccttattactcttgtactagtttcttttctctctgcctccacaggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcgtccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaaaaaaaaaaaattttttttttttttttgctatatactcttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcactccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggtggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacat

SEQ ID NO: 9648 - DNA, 13186 bp, Homo sapiens
aggctggagtaaaagggacattgggaagattagttggaatttttgaggtaagtctgttaaaatctttggtacaaatgatatgtattaataaccacacagatattaacataggaaaaatgccatttctgtttcagcgagtttttttttttttagttatttttaactttttgagacaaggtctcactctcgcccaggctggagtgcagtggcacagtcatagctcactgcagccttgaactcctgggctcaagcagtcttctgcatcagcctcccaggtaggtgagactacatggatacaccaccatccttctaaatttttaaattttttgtagagacagggtcttgccatgttgcccaggctggtctcaaactcctgcgtttaagcgatcctcctgcctcagcctcccaaaatgccaggattacaggcttcagccaccatgcccaacctcggtgagttttttaaagaaagcaacaccaacagagaataacatgctttaaaaaaaaaagaaagaaagaaggaaatcccatagtcttgtcccctaaactactagaattatttttaaatattattttaccccattcctacttttctttgtctcctaccaaggtaggaggaaaggtagctaagtgtagagagagagaagaaaaatagaagataagtaactataacaaagagaggaaaaacaaggaaataagctgtgatacaaatttgaaagaaggcagggaaaagtgagaaatcaggagaaatcaagatgagcagatgctgggcgtggtggctcacacctataatcccagcgttttgggaagctgacacaggaagatctcttgagggtagaagttcaagaccaacctgagcaacagagtgagactctatctctacaaaaagtttacaaaataaaaatgtcagaagaaaggtctctgatgaaaaaatagatatgtaaataaatcttttttttttttttgagacagagtcttgctctgtcacccaggctggagtgcaatggtgcgatgtcggctcaccacaacctccgcctcccaggttcaagtgattctcctgcctcagtctcccaagtagctgagattacaagtgcccgccaccacatctggccagtttttgtatttttagtagagacaggtttcaccatgttggccaggctggtctggaactcctgacctcaggtgatccacccaccttggcctcccatagtgctggaattacaagcatgagccaccgcccctggcaataaataaatttttttaaaaggtggctgggcactgtggctcatgcctgtaatcccagcattttgggaggccaaagtgggaggatcacttgagcctaggagtttaagaccagcctgggcaacatggtgaaatcctgtctctacaaaaaaatacaaaaattggctgggtgtggtggctcacatatgtaatcccagcactttcccaggcctaggcatgcggatcacttgaggtcaggagtttgagaccagcctggccaacatggtgaaaccctgtctctactaaaaatacaaaaattagcagggcatggtgatgtgcacctgtaccagctactcaagaagctgaggtgagaagatcacctaagctcaggaaggtcaaggctgtggtgagccatgatcatgccactgcgctctaccgtaggtgacaaagtaaggctctctctcaaaaaataaggtaagtggggttagtgggaaaaggggtgtgggtgggaagaggggtgtgggtgggtgtgtgtgtgtgtcacactcagcttgtttgccttgctggggtcactgaagtttgagacctctgtggtagcccacccatccacagtcctctccctggtggtctagctagttaaatttacatgatgcctttttcttctcatagtattcctgttaagttgtatttaggggaaggggaggaaaaaccaatataattacttggttttagaagtccagccaaagagcacaccctcaaattcaagtgtggcctgctttaaatcatgtagctataactgtaggaccataaaaagtaaaagtttagaatctttgtgtctgagctctctggacatatgcataagagtgtgtttcatttaagtaattccagctttctaaggaaaaactctctctatccttctctctttgcccttcagaaccaggagaggaagcacaggacgtatgtctatgtgctcattgtcactgaagtgctggaagactgggaagattcagttaacattggtaagccatctccagacagcctggaaagggttcctcacaaccagcccttgccatgccacaggtcatgaccagaaccagaaacaagagcgtaccaggctcagtggctcacacctataaccccagtactttggaaggccaacacaggaggatcacctgagcccagagttctagaccagtcttggcaacctagtaagacctcatctctacaaaaatcagaagacttagctcggcgtggtggcacatgcctgtggtcgcagcttctcaggaggctgaagcaggaagatcatttgtgcttgggagtttgaggtcacattgagccataatcatgccactgcactccagcctaggcaacagagtgagactctgtctcaaaaacaaacaaaaaaacagaacaacaagagctggataaagaatagaaataattgaaggatgtgtataataaaacaagcatgtacattttgaacctgatagtattttgaaatgtttaaatggaatctgaagtgagtacatggtccacaaatagaagcatgacccctaaaaataagaaatgttgcttctaaaatcaaactgggtccttgccaaaagggctatacttctgcacctcctgagcagatactgattgagggcctccgccatgccaggctcactgctggccatggggaccataagtgagagcaggaccctggtcttgttcctcatgacatttatattgttgagaaaactgttggtttggtggtgtgagtccctccagaaatcatttagtagatacagaatagtgcaggtggtttctagttttattcttataaaatatgaatatatctataatatatatttttatattttttcatattttatatgaatataaaaatgataaaatttatgaacttttacaaaaggtgctgtgtgtaccctttaggtacacccaactttctcccaaaggagccattttctttgatctcagatggctgttacgtttacatctttggaactataaactgtggtggtacaaaggttggttcatggtttgattgtttacttctgaaggaaagtgtattctagaaaggagaacactaatttccattacaaattggcagacagataaaatttatttgccaacattctcactttaatgttagtgtttgccttgccgccatgcccctcacattgttactctgggcagttcgtagccctttggctcttgatggctttgtgtctagtaataatgcagggtgctcaaggaaataaattcagtgtggatatactgaaaacagactccctaacaggtgtgctagagcttgaaaaggagactgcggtggatgtgtggtgtggccctatcctcagagcactctctgtcaggcaggagtcatacacttgtgatactaatttttttaggtaccattgctctattaatattcaaacaagcctttcaccttgtactcccacttctgagaattgaccctaatgaaataatctaaaatatgacaagctatggagccttccttcagatgatcttactaccattattcttactggttaaaatttgcatcttaaatgtataactcaatgaatgacaaatcaatgaatgacatgtgtccgatggaatgttatacagctgttaaacaccatagtttaacaccaccctgttaaactgcagttgcagtggctcacgcctgtaatcccagcgctttgggaggctgaggcaggcgaatcacttgaggtcaggagttcgagaccagcctggccaacatggtgaaaccccatctctactaaaaatacaaaaattagccaggcatggtggcacacacctgtaatttcagctactcaggaagctgaggcaggagaataacttgaacctaggaggtggaggttgcagtgagccaagaatacaccaatgcactccagcctgggcaacagataagactgtttcaaaaaaaaaaatttttgtcaatgttaaagaaaagctaatattggcaggaatgtggtgagactgacatcctgacatacacaagcaggactggggatcagtgtcgcctttctgtaaagcacttttgcagtataaatcaggagcccttgaaagttcagaagctctatttttgtagttcttgtgctagatatctttccctagaaggttaaaaagaaagaaaaaacggggaacgttttaaaaaaatagcattatttataataattaaaatcactgggcatggtggatcacgtttgtaatcccagcactttgggaggccaaggcgggtgaatcacttgaggtcaggagttcgagaccagcctgtccaacatgctgaaaccccatctctactaaaaatacaaaaattagctgggcgtggtggtgtgcacctgtagtcccagctacttgggggctgaggcaggagaattgcttgaacccgggaggcggagattgcagtgagctaagataacgccactgcactccagcctgcatgacggagtgagcctccgtctcaataaataaacaaaaattagctgggtgtggttgtgggcgcctgtaatcccagctacttgagaggctgagccatgagaattgcttgagcctgggaggcagaggttgcagtgagccgggatcacatcgctgtactccagcctgggtgacagactgagactctgtctcaataataataataataataatcacagacaattgatgtccagtgatatggaaatgcttaagtgaatgataatacatccatactagatactatgacataatgcagccataaatgtcttaaaaaaaaagacagtctcactctgttgtccagactggagtacagtggcatgatcacagctcactgcagcctcaacctcctgggttcaagcagtcctcctgccttagcctttctagcaatggcaatgtctcatatttttttcataatatagattgcttaagaaatagtgtgacataggacaggtgtggtggctcatgcctgtaattccaagtactttgggaggctaaggcaggaggatcacttgaggccaggaatttgagacctcatttataccaaaaaaaaaaaaaaaaaaaaaagaagcagcagcaggtgtggcacgtgcttgtagtcctagctacttggaaggctggggcaggaagatccctcgtgttcgggagcttgagtttgcagtgaactatgatcataccactgcaatccagcctgtgagatcctatctctggaaaaaaaaaaaagagagaaagaaaaagaaaagaaaaaataacatgaagtaaaaaccagtaacaaaaattaaaaagcaaattcagcagcacattcttttagcagccagttactcttcaggtgctttccatactaatagtcataacagacttgtgagataggccctatttattgtctgttttatagatgaggaaaatggagcaggaacacagctacctgaggctgcacagctcattggagccatttatgtgattggagcccagcactttggcttcagagtccttgttcctgaccataacactctagcagagctggtcaggattcagagtacctgaaagcatgatccaattttggttgtctcaagattgtttctttttcaagtatatgaaaaaagggcagttgtgctagggtattgagagtggttttttctggtttataagattatgggtagttattacttttataagataaaaaatataaaggattttaaagcatggactagaaaagagtaagaaaatagactgaaaaataaaagtgtgattgtattgagattatttttacttcttttaagaaatattttctattatgtagataaattcactcttataagaaaacttttaaatgaattactgattacaaaccagccatcctagtaattctggaagctgatgctcgtgttgatttttccccccttgggacagggtctcactctgtcaccctgctggagtgcagtggcgcgatgacagctcactgcagccgcgaccttccgggctcaggtgatcctcccacctcagcctcctgggtagctgggagtacaggcacatgctaccatgcccagctaatttttgtattttttgtagagacagagttttgccatgttgctcaggccagtctcaaactcctgggctcaagcgatccgcccaccttagcctcctaaagtgctgggattgtaggcgtgagccacctcatccggccctcatgtcagtttttacaggagatggggatgctgctgggctttgatccctatgtatgtgcaagcaaggaaagctcagagacgcaggagggcaggaggaaaacactagccgtagttctctctggagggcaggttttacacaattactcttagctctttggttttcaggtttctcacctttctgcattagacattgatataatatttgaagcatatgaagtgtgcttgagttatttttgtaaggaaaaaaagtgttaagaaacattgctttaatgttttctatattttctcaaaagttctaggctcagaaaccttattactcttgtactagtttcttttctctctgcctccacaggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaaaaaaaaaaaatttttttttttttttttgctatatactcttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcactccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagc

SEQ ID NO: 9649 - DNA, 187 bp, Homo sapiens
cacgcctgtaatcccagcactttgggagactgagatgggcggatcacgaggtcaggagatcgagaccatcctggctaacatggtgaaaccctgtctctactaaaaaatagaaaaaattagccgggcgtggtggcgggcacctgtagtcccagctacttgggaggctgaggtgggagaatcgcttgaa

SEQ ID NO: 9650 - DNA, 15360 bp, Homo sapiens
aaggagggaaataccctttattttttaatttttatttttcggagactgagtctcattatgttgcttagactggtctcaaactcctgggctcaggcgatcctcccacctcagccccttgaatagctaggattacaggtatatgcccctgtacccaaaatgcccttttttgttcctgggactaaacgggaaaaggagggcaacagggagctctggctgcagcaccagaggaacccactggaagggaaagggcagatagttttgtttctttattatttaaaaaatattaacagcaattaaaaacaacaacaacaacaaaaaaaacattcacaacctgtcacagagtcctataagctttggccatttattcccaacggagtctttcatccaaaggcaggtggggaatttcagccaaaaggccccttcatggttttcatgggtgggtactgctgctccatcggcatggccccaaagcagtcagagggattacagtggccagccttgcctggctggcccatgggacccgggggcccagggatgccagggatgccttgctggcccattggtcctgttgcacccatcttgccatagcctggaggaccttgaggacctagggagggaagggccacagagggaaaatcagaagacccagatcataagggaaaagaagccataatggcatcaaataataccttacatttgatgactgtttctcaagttaccacatgttttcatgaagacctagtctgatcctcacgttgatttaacaataacaatactgctggcaagttttatttagaacttccatgtgccaggcacagggctgagtgcttttgatgcattattcattgaatctgcacaatttcctgagaaagaagctattgtctaattttgtagatgaggacacaggctcagagaggttgcacctctggtaagttgtgatgctgggtctcagagccaggtcatcaggctttggccatcctctttcaggctatatagccaaacattcatcgtagagagcacttccaaagggcttaagtggcctcttcaaggtgtacagccagtgaggtgctgagtagaacttgaactcgagttcctcatccccacctccatgcagctctctcctactgcatcatgctagcccagtttaggacttaaggacaggtactgagtcttccgcccccacatccccacaggccctggcagagtgtcttgcacacagtggcattcctataaatgtggttgactggcctgtcgttatttggagtttgacacagctgtgtcatagaagaaacagaaagaaaaggggtctctgctgctctggattcatggtctcaaatggtggtatttcctacctggggggccgggaagaccattttctcctgcaatgccaataccaatgtcccctttttcacctttggtaccaggcaatcctggaacaaaagaaataaataagtcctatccctgagcagaaaaatgacacagccagtcagattacttgaaacacacacacacacacacacacacacacatacatcccatattcacaacagacctcatggaatacttaggcctgccccaaagaattacatgtgtcccttgggaactgtagggcagagctacctcttactcctggcaagccctgccgtccttctctgccaatctgaccagggagcccaggtgaccctggagcacctggcctgcccggagcaccatccttccctggaggccctggtcgtcccggagctgccgccatctccatggggaactgcatcctggaggtgtagtaagccattctctctgtaaaaaaaggacaaggacagggacaggtcagagggtcccccagggactcagaatgactgcagatgctgcatataggccaccagcatgaagtccacagcagccttccttcacagggatgtcagggcaaggagtatgggggtgggtctcgcaagggggttcccacgtcctggcctccacgtcgctccccatggagatccttccaaagcacagatctgactatggcatctctgctccaacacccctcattagttcaccgctggcttcagaataaagtccgcattccttgcttggcattcaaggtctgcttcccaagcaagacgtccagccctttcaggacagggcctgtgttttccccagtccctggcacatcaatgttggatgaacaaatgaacagaaaaaaacacttcaaataaaccaccccagccatcttacagtgccgctcgcccctgtatttagagctcacttcaggcagactcgtttaataccaattttcttgtctgtctcctttgctcaagtgggggctcggggaatgcaggagggaatcattttatctctgaacagaacaggagacaaggaaggtctgaaggataattgaacatctgcctgtcaaccccaggcctgtgagtgtgtggagggtgagagcaggaggacattgagcgttaaggagaaagaggccaaggcagggcagagaagtcacaaggaagggcagacagcacccactgccacccagctggctgccagttaccatcaaacattttaatgatctcttgtctgatgaacctcttgatttcatcataattcaccatgtctccctgaagaaagagaagaaaacctgcctcaattatacttccaagcctggcattttcccctatggaaataaaggatggggaggaaggcaaaggtcccaggagcctcccacagattcttttttttttttttttttttttttttttctgagacagagtctcactttgtcacccagactggagtgcagtggcgcgatcttggctcacagcaacctccgtagattctcaatccaaagtcctaaccacccagatatgatacaaaacattttgttcttaagtgcatttttctggggagagggtcctatcatccccacccttccgcacacagttaagagctgccctctatgggagccaggctctttcccacagaatgtcagcaggagcttggaagatgatccgagctccaccccacatgcctgctctatgggacagtgcccacagctgccagccttcccccttaccatggagccaggcacaccaggcaagccagggctccccgaaggccccggagctccagggtggcctctctctcctgcagggcccggtggcccaacaggccccatggaaccactcttgccaggtccaccaggcatgccggctctccccttctctcctgcctggcccttctgtcctgcagctcctggatcaccctacaaagatagatacttagtgctgtcaaatttacatcatgatgtctcaccaatctgctcttttctctccaccctcccaccaggcccccagcgtctccctctagactgtggccacagcatcctgacaggtcactccacctcactgccccagagtggtccttctagaagacagttctcctggtgttactccctgcttagaaattctgatggctcccaaatgtcctcaggataaagcactcattcgttggccgggcatgcaaggccattcattatgtggtcctgatcgttccttcctcagcctcctctccccaccctctgcctcccaccagacctcactggtgatgattctctgattctgccatgttgttatggtcctgaatgcccttcccctcatctctctctatccagtgcacccctcctgagctgaagtgttcctgttctctctgcagcctctccgactccccaggctgggttgggtgctcctccctctcatcccacagcgctatgtctcatgtcttctggaaaacttgccaatccctagtgtaagtgtgactggtctattgtgagcacctattgttcagggacctctgtttacctgaggccaggacaagggcctggaatgtgagcaggagcaagggagtgctcgggaaatggaaacaatgaatgaatcaatcagtcaatcagtgagtaaatgaactggagatttccttccccccaaccacagctaatgaccccatgtgagaaattttcagacactatcctgctccaagttctgcatttttgccccctgcccactggccttcctgtgtctcctctctgtggctaaagccgtaacttgcagctgggcttcatccactcgtgagcttctcctctcaagcccagccagtgcccactcaccttgggaccaggaggtccatagaatccctgctttccagggggtccctagaggaaagcaaaagtcagaggtgaagtccgggcagcatctctgaggctccctggggaggcaggtgcagtgaagaggccccttccacagcctgaggcccccaggtgtgtccagcccagctctgtgtgagaaaggagcgcagcctccctgcccagctggaagggaaaataatgtcctctggggcatggccttgtttaagcatgttggctgggcccccatcacagatgaagagaggcgagaagtcagaatgagagggccagtctgtggcatactggggggcctggaaagacctggtacccaggagatgtttgtttggaatttattattatcattattattgttgttgttgttgtttctttttgaccaggtacagggtttaaaaaaaaaaaaaaaaaggtaaaacaaatctcactcccatccttggcctcaagtctctaattcctctccccaggacaacagggttaacaatttccagagacagcccgtacatagaaggaatgtttactgaaaaaaatgaagaggggtcagggcaaggcgaggagcaagaagcacccccaaggaaacagagaagaccagtacaactgtacctctttgccagctgcaccatccgtaccaggttcgccctggggagtagagagcaatggagacatgaggagctccaacccagtttggtgtcagatgcctcactttgtacatggggcaagcccagccccctgttccacccagaggccacgatcctccagccctcaccctctgacaatctgggcacaggccgtggaaacttagacccccaccccatactccagcgtgatcccagagccccaacagctcccagcccccgtctacaagagctttacaagggaagaacagaccgtgcctgccttgctgtgtgcttggatcctggcaccttgcacactccctggctctgaatctatgttaaacgtttgctgaatgaacacatgaacagcctgagccggccccctccctgagaccagcaaggcagcctctcttctggtggctgctggggaagaggactctgattgctaggcaagtgggagattcatccaggggccatggaggctcctgagcctgcaaggagggaggcagggtccttggcaggaatcagagcgaataggcgtggtgagactgggcccgcctggcagatgggctgactggagtcaaacaccccagcccaggccaccagccccacggtcactgctgctgccccccagaaaaagtctgcgttgatggaaagcatcctgatgggtcccaggagacctgggtccctgcctctgctctcccaggagacttttcatccctgaccctggcaatcagttgcacctgttagggttcacctgtctggaacttttgagagaggtagatttgcagagtggctaaggacatgagttctggaatcaggcaggctgggatcaagtcagagctcttccactcactagctatgtgactccgagcaacctgcctaaccttgcggagcccccgtttcctcatctgtaaaatggggacaatcagatccactaaatggggctgcggcacagattaagataaaatgcacagcaagcacttagtccaccattcggcacacatcggtgaccgatatatcagcgctcttagtgttaaacgtgagctgagaccaagtcctggtttccgaggacctcaggaagttacagtaacagcactgcatttctggttcctgacatttagcaagattttctgtggttactgacaagctcccctggggaaggggaagaggcagaacagggacacgtagccaaggggtctgcagaaggttgatgctgaggcaccgtcatgggcagtgacctcatgtgcagcctggcacagcactgcagggcctatccttccaaattcagcatgatcctcaggcccgaacgccacgctgccatcctgccatgctgacagcctctccttccttagagaccccagatatgttgtgctgtgctcaacaggccttgagccaattgactctttccccctgggctatgctgtagaatgtgggatcttactggggggccagggtgtccaggggggccgggctggcctgggaggcctgcaaggcccctttctccggtggctcctcggtctcctttcagaccctagagaataggaagggggacagtgagaggggaggaaagcaggcaaagtggactcccatatagccagagacagacaccccatcgtgtgccagggactacagggagaggtggcactgcctgaacttgcagcaggactctgagatgacctccagccctctccaaagccctctgccacatcctggaaggcgagatctttggaggcaggagaggctgacaccagggaaggaggggatgagacaaactgttctccatccccccagcttcctctgaatggagcccacagtcaagcagggcaaaactcctgggagggaggaaggagtggagcatgttactcaccactgcagagatcccagctggtcctggctggcctggaggccctggtggcccctaaagagagatgagtcagtgggatagaaacaggttctaatagtaagacccctgggaggcacagggcctgacagcagaaacaagctctaaacttcagcagctccatttcctctggaaaccttccttcgctctggtcttgcacttgagcttcggacaagatttgcgcccagagctgaggcctgggggtcctgggcacacaggaccctccctccaacccaggctgagtggagcatctggggctgtgctgagggggatgatctgaaagccgtggccagaggccaagtgcagaggacaaaggcctgggggagttactccctggcctaggtggctactgagacccttgcttccctaaaggcagtctacttcctgctgttctatggaggagggaagaccagaagctgggggtccgtgtagcagggggtgaggggcaggggcttggcactgaccccgacatccatagtgacaaggagctaacacttgctggccaacactggagcgcacgggactccaacacccagacagtccctgctgctgcactagggctgcgtctgaaatgcccttccctagctctgatgcctacatccatgcctctgtggtgcaaaagatcacctccctgatcagagtgacaccttctctgaacccccggggcacttgggtctctcttatagtgcttccctcaacacccccaggtggcacgttccagagccatagcctctgttctattcatctccagtctcctggggtggaagtgtccagcacagagactgccacactgcaagacgaaggggctggacacacggaagagagaggcggaaccctgcaccccctcaacctcagccctattgagtctccaatggggccacgcttgtgagtgcacctccccgtgtcatctgtaatgtgagggggaaccaggcttgatatggcattcccaatccagggcctctggaccccttgagatgcataaaaatagtgatgggggcctgagagttctttttttttttttttttttttggtcatgaactatttttaacatttccgaaagcctcctggaaattattatgcagccagccacaacagggctgcaacaaaatgccagtatcttcgcttttctctggagtcccatcagctcagtgccgtcacactgatcaaaggcactgcctggcagtcatctatgttagtgatgagtaaagtagacaggaaattcattgttgcttgataaatgtcctctccaagtcaccccatcttgggaaacacaccacctatttacccagttgcccaagtcaaatgcaggagtcacccctggttcttctctttctgtcactctgtctccccaaccccaatccagctcatcagcaagtcccccaagcctggcatggcacaggggctccacaattatttgttgactgaatgacctccatctgataagtgaacttgaatgtgcccagaaaataagaaaataacgaaaagcctggaaaccacagaaggagtggcccccgtgctcccacggctggggcagcccctatggcaagttctctcaggtcatgacagcctatgcaccaccaaccaccccgccaaaatgctaactcttatggagacagagacaaaagtggttcaactcacaacgtgtcccgggggaccgggtcttccctggggtcccatggcaccaggttcaccctgcaggagccagaaaaaggaaaaaatgacactgaaactgacttgcttgcaccatgtggctgtcggatgggagggggctgggcagaatacatggtaatgccaatggccaaaggagctgggccaattcccagcctccagacccaagtttcccggagagttaggtagagaaggcggatcctcagcctgagcaggccaggccctgcctttttaggttggtgacccagtaacctccagggagcagaaccagttacaacccttaataggagggagaaagttcaagacgtgcagtgttgggtgacacccctcccagaaggctgaggacagaaagcagccactttgccagtgagcaggaagaagcggctgcatcccagactctgcagagtctgaaggcaaactgaaggcagccatgtggatccctggccctcacctctgcgccaggccggccagtgctgccagggggacctggtttgccacagtcaccctagaagagagaggagcagctggagcttaccagaccttcacttgacatccctaccccaagtcaacctcacatcagagggaccctgccacctgccccagctttggccagaggccctctgatgccctccagctggtagacagagaagccctgacccagtctgccaggcaccagtggccccaggaggctctgatgctgggatggcctctctgcccaggataggctgccatgtatgcctgggggcaagccttcaggagagcagagataacctgcttggcagaggtcaccagcccttaccttaggtcctgggaggccaggatgtcctgttttccccttaaagccctgaaagaaaaagcagggagttctcatgtccctcatgtcagctgggggcctcttcccactcctccttcctcagttcaaacaattcaaaccaatccaaagtcataacacggtccacggaggatctggatttgagctgttgcagccacccaggcagaagctgcaacttcgcagcttccaactccttcctgcagctcaacttaccggtggtcccatgagtccaggggggccagcaggaccagggtccccctagggaaagagacgaggaggattgagacaagagttttgcccagcttgtatccaactcatacctctgtcctcccctctctccagccctccccagctatcctaagatggagggaagaatccaagcctggctcagcctctgactggctgtggatcctcagtgacttccagcccctctccgggccttagctttccttctttgggatatataagggggttgactttgatgttctaccctgtcctgtggccccagccctttcagattccccagcaaaaccccaggagccagggcttgctcaagtccttccatgtccacaccctcattcttcctgaagcccagcctggtttcctcagctgtcttgagtttctgcatacatcatgccttcaccatcctgcctttggtgagacctagctcgcctaacctgcttaaggccactaggagaactgggaagccaaggggctgtggtgccatcggggagctggggtagagggagacagaccgagggagggcatgggtgccccctgacaaagacggggatacttcggttctttccatcagggttcccttgactttggctcctctggcaaaaaggagaggaaggggtgcccgccctcccagcccatcatctcaccctcaagccaggcttgccgtccttcccatccaaaccatccagaccggcggggccctggaaacaggaaagaggcatttctacatgctggtgcgggagccctaggaggtgggaggcctggcccaacccctcaattctctccacccctcccctgactcccacctcagcacacacacacaggtgcacacacacacatgcaccacacacatgcgcatgcatcgcacacgtctgccacgctgaaagggcacacactcacctgaatcccaggaggtcccggtggcccaggggagccaggcaggcctgatgggcctcgaatcccttcgctgccctggaaaccagcgccgccccccccccccgccccacaataaagtcagcagggctttgccccacccatggagaccaggccctgggtcaagggtcctggtgactgctggaaacaggacagctggcttctgggcccaatctgtccctgtctaactgcatatgtgccacacgtcgcctccccaggaggatctgtcttcatctgcaaagcatcccctttccttgctgccccatgaggaagggacagggcatcttctccagtgctgacccaggggctggcatggcaggggctcagtagcatgtgctgaactgaaagcacagcttcaatccactgtgaaagctgcctgttgtattctactccatcagaccccctgcctcctccccacctacctccctacctttccccccatcccagcagacatgggcccgggctgcacagaggcctcaacagcgcacgcagcaccatgtgggctctgattccccaagatgaaaaagtgggtgcccctgtcctcaaggagctcacagtccagtgagggtcatgggcccaacacaaccaggggcaatacaacagtctaagtgttctgtgtggaaaggggctcagggagctcaggagcggggagcagttccctctggctggggatcagggaaagtgtcacagaagtgtcaccagatgctagactctgaggatgtctgggattgggcaggtggaggagaaaagtgcatgccagagggaacctaagagaaggataaagacttgcaagtgggcacatgcctggcctggccagggcatctgggggagcctgtgggatgggctggcaggcagaagaggctggaagagtcaccatgatgagtgggggccctgaacgctgtgctaaactttatcgaacagtcagtggtttttaagctgtacttctcagagcactggggcttctgggggagcctagaagctgggggcatgaagtggggactgaagagagggactctaggacccccaccgttgtcttagccagggaatctccgcttgtatttgttttatagattgaggtttttacatttgcttttatgtgataaaaagactctgggactacaaaataaagtctgaaaacccctgctacaggcactggggagccattgaatgttcaaagcagaagagtgatgagaactgatgcatggattggaatgtttaccagaaaaggcggggggaggcaagcagcatagcggggaaggtggctgcattctcccagtgtggagagggtggctgccctggatcagtggctgtagggtggtcaagggaaggaatcccgctagagagacccagcaaaggggaaaatgaactcgggggctctgtaatgccaccagccaccaggaggggtcagcagagccccaaccaatgttggcccccactggcagttgggatgaagaaccactggccagaggtttgggattctctgcaatgaccagcctaaggagagcaggggctgccactcaggtcctggggaggggaaggaaggggaaggggaaggggaaggggaaggggaaggggaagggggctagcaaccaccactgtcccaagcatggctgatcagcatgggctctggggaggtagtgaggtgcccgggtcctcctggagctgggaaggaagtctcagctctgctgctaacaccactgtgtgcctctgggctgccccaagccttgtgggtgtcagtttcctcacctgcacagtgagacgttcatgcgtgtgctctcaggggaaagaggctctccacaaggctcaggggaaagaggctcccacctgtccctctgaacccaggtcccccgaccccaagctcagaagtcaatcttcgggcttcttacaccacccactcagcacatctagggagcccagaggttgggccgagacagggatgtcagccccaagccaaggcagagccatgtctccagcatttatcaagccaaagtcaagagcagccagcataggagctccgccaactgctgctcccccaacccttgtcaccaggcaggacacgggccacccctgccctctctgggcccttggggacaactggagcacggctacccaggaggagcccattccccttccacgttggtgtcctccttcaggacgtgcttcccccttctctcagctcctcgctcatcctcccgcccaggagacgaaggtggcctgggctgcctatcacattctactcctccatcagaccccctgcctcctccccacctacctccctgcctttccccccatcacagcagacaagggcctgggctgcacagaggccgcaggcatcctgggccaagcagacatcccgaggagcccactggtccactgcaagccctgtcggcctccagtagtcactgggcccatcctggaggcctcttttcccagcctcagtgcaactgggtcagtcttggaatttcctgaaagcctgatgctaggggtgggacaggggcatgggagctgcatggctcagatctgtgactttgccaacccagggtcctgctcaccttctctgcttgagggccaggtgggccaggtgatccaactttgcctgggaatccagggggaccctgtatcaacaaaggggcaggcaggaatgaaagtggggctggagggggagctccccttctttattcttcctgtgcatgatgcactgttgttaatgcaattcattttgacttcctagaagcaccacttgggagcattacgtctgcctggcctgctgggctggggcccacacaagaggctgggctctccaggtcctggttcctggaatcaggcctggccacccaggccgttctcccctgcctctcccctcttctccccaggaccatcctaccccagcctggcctggtcaggcctgcccctcccgatgagaccacatcagacagagctggctttgtgtcttcttcactcaccggtgggcccggaaagcctggctggccttgaaatccctagggtgagaagcaaggggcagtgtgctgtgccaccccctctctcctgcctggctgcccaggtggaaagagtgacggggggggcaccctcaaacccatggctttgccctcccctctgcccaccatggctggcaggtgaggctctgggcatgaggtaggtcacaacccaaggacaggtagggtggggagactagagctggtgatcaccagggacccagctccttccctgcctccctgcagccaggtcccagtcgtcactcacctggtcgcccttctcaccggagttaccttggggtcctcgctctcctctgggaccctgtcacccacagagaacaatgcagccgaaacctaatcttcctgccctcagaccccaggacaagaccaggaccacatctccccatgccctccttcactcaccgctgggcctggggggcctgggaggccttcagatcctggggggccctaaggatacaaaggaacagaatcagtcactcctcctggggaggtgaaggatgaggtagggggatgtgacaggggactgcccagaacagaggtggcatgtgctgggaggcccctgggctggcaggccccctctgcctgatctgctcaggcttccctgctcttgcccgagctactgaaccagcctcctaactcgtcctgccacctcctggctcactgcaagccagccagcaaatggctgccctcttctcctccagcatagctctgattatgtcactctcttgctcaaacaccttatgcggctccctctgcctctgagtggggcgcacactttccaccaacgctggtctttgaggcagcctgtgatctggcaccagccaccccttcccacttctcctccctctctccttctcatcttccgccttgctcagtcagactgctgttctctgacacactctataccctcacacccccaggcctttgcacccttagcacagctttctcttctacctagaatgcccccttccccccttcctaggtcccctgaacccttgccaaatcatctgatggctggaagctgttcctgcagtgccccacccagcctctccctctggaattccccagtacagacagccacagggatccctccctcctgctagtcagctctcagctcatatgccacctgctcagagaggccttcctgcccctccgcttcgatggtgcccaaacacctctccagccccttcccctgtcccatttcctccatgagtcccagtcctcatcgttcctaggcacttgtttattcatctggcagctccctcccccacggcagggcaagagggcaactgcgctctgttcatggagacatcctcagaggggagcctggcaccccacaggcccctgagaaatatctattactgagtaaatgcctgatggagtttgctgaatcccactggggcctcactgaaactggtgaatctgtaaggctgcagtcccagtttggctgatcctagatctgaggtttgtgaggtttgtcaccagatagatgtgtgttcaagcccaggttccaccactacctcactcactagcttcaggagcctgggtgagtctcagctttgtcactctgggggccccagtgtcctcatctggtcacagcccaactcctgtgctcaacgtggggcctggcaggccttggctctggagggtggctctggggagctggggtccactgggggtctataatcccaggtcctcctttgtaggaggcggaggagtgcttctgcggctgcctcctggcaccctccccttggcagccctgcggggattctcctcacagcctccacctccacagcacccagcctgtgctgcaggcttgggggcaggggggcagcaggggtcacgatcctccccttcacaggctgctgccaagtctccagcccgagactgtgtggctccacgtgcagccctgcatccagccccacgccgctgggactcaccggctctcctttctctcccgctgacccggtgta

SEQ ID NO: 9651 - DNA, 8667 bp, Homo sapiens
atgccagggatgccttgctggcccattggtcttgttgcacccatcttgccatagcctggaggaccttgaggacctaggagggaagggccacagagggaaaatcagaagacccagatcataagggaaaagaagccataatggcatcaaataataccttacatttgatgactgtttctcaagttaccacatgttttcatgaagacctagtctgatcctcacgttgatttaacaataacaatactgctggcaagttttatttagaacttccatgtgccaggcacagggctgagtgcttttgatgcattattcattgaatctgcacaatttcctgagaaagaagctattgtctaattttgtagatgaggacacaggctcagagaggttgcacctctggtaagttgtgatgctgggtctcagagccaggtcatcaggctttggccatcctctttcaggctatatagccaaacattcatcgtagagagcacttccaaagggcttaagtggcctcttcaaggtgtacagccagtgaggtgctgagtagaacttgaactcgagttcctcatccccacctccatgcagctctctcctactgcatcatgctagcccagtttaggacttaaggacaggtactgagtcttccgcccccacatccccacaggccctggcagagtgtcttgcacacagtggcattcctataaatgtggttgactggcctgtcgttatttggagtttgacacagctgtgtcatagaagaaacagaaagaaaaggggtctctgctgctctggattcatggtctcaaatggtggtatttcctacctggggggccgggaagaccattttctcctgcaatgccaataccaatgtcccctttttcacctttggtaccaggcaatcctggaacaaaagaaataaataagtcctatccctgagcagaaaaatgacacagccagtcagattacttgaaacacacacacacacacacacacacacacatacatcccatattcacaacagacctcatggaatacttaggcctgccccaaagaattacatgtgtcccttgggaactgtagggcagagctacctcttactcctggcaagccctgccgtccttctctgccaatctgaccagggagcccaggtgaccctggagcacctggcctgcccggagcaccatccttccctggaggccctggtcgtcccggagctgccgccatctccatggggaactgcatcctggaggtgtagtaagccattctctctgtaaaaaaaggacaaggacagggacaggtcagagggtcccccagggactcagaatgactgcagatgctgcatataggccaccagcatgaagtccacagcagccttccttcacagggatgtcagggcaaggagtatgggggtgggtctcgcaagggggttcccacgtcctggcctccacgtcgctccccatggagatccttccaaagcacagatctgactatggcatctctgctccaacacccctcattagttcaccgctggcttcagaataaagtccgcattccttgcttggcattcaaggtctgcttcccaagcaagacgtccagccctttcaggacagggcctgtgttttccccagtccctggcacatcaatgttggatgaacaaatgaacagaaaaaaacacttcaaataaaccaccccagccatcttacagtgccgctcgcccctgtatttagagctcacttcaggcagactcgtttaataccaattttcttgtctgtctcctttgctcaagtgggggctcggggaatgcaggagggaatcattttatctctgaacagaacaggtgacaaggaaggtctgaaggataattgaacatctgcctgtcaaccccaggcctgtgagtgtgtggagggtgagagcaggaggacattgagcgttaaggagaaagaggccaaggcagggcagagaagtcacaaggaagggcagacagcacccactgccacccagctggctgccagttaccatcaaacattttaatgatctcttgtctgatgaacctcttgatttcatcataattcaccatgtctccctgaagaaagagaagaaaacctgcctcaattatacttccaagcctggcattttcccctatggaaataaaggatggggaggaaggcaaaggtcccaggagcctcccacagattcttttttttttttttttttttttttttttctgagacagagtctcactttgtcacccagactggagtgcagtggcgcgatcttggctcacagcaacctccgtagattctcaatccaaagtcctaaccacccagatatgatacaaaacattttgttcttaagtgcatttttctggggagagggtcctatcatccccacccttccgcacacagttaagagctgccctctatgggagccaggctctttcccacagaatgtcagcaggagcttggaagatgatccgagctccaccccacatgcctgctctatgggacagtgcccacagctgccagccttcccccttaccatggagccaggcacaccaggcaagccagggctccccgaaggccccggagctccagggtggcctctctctcctgcagggcccggtggcccaacaggccccatggaaccactcttgccaggtccaccaggcatgccggctctccccttctctcctgcctggcccttctgtcctgcagctcctggatcaccctacaaagatagatacttagtgctgtcaaatttacatcatgatgtctcaccaatctgctcttttctctccaccctcccaccaggcccccagcgtctccctctagactgtggccacagcatcctgacaggtcactccacctcactgccccagagtggtccttctagaagacagttctcctggtgttactccctgcttagaaattctgatggctcccaaatgtcctcaggataaagcactcattcgttggccgggcatgcaaggccattcattatgtggtcctgatcgttccttcctcagcctcctctccccaccctctgcctcccaccagacctcactggtgatgattctctgattctgccatgttgttatggtcctgaatgcccttcccctcatctctctctatccagtgcacccctcctgagctgaagtgttcctgttctctctgcagcctctccgactccccaggctgggttgggtgctcctccctctcatcccacagcgctatgtctcatgtcttctggaaaacttgccaatccctagtgtaagtgtgactggtctattgtgagcacctattgttcagggacctctgtttacctgaggccaggacaagggcctggaatgtgagcaggagcaagggagtgctcgggaaatggaaacaatgaatgaatcaatcagtcaatcagtgagtaaatgaactggagatttccttccccccaaccacagctaatgaccccatgtgagaaattttcagacactatcctgctccaagttctgcatttttgccccctgcccactggccttcctgtgtctcctctctgtggctaaagccgtaacttgcagctgggcttcatccactcgtgagcttctcctctcaagcccagccagtgcccactcaccttgggaccaggaggtccatagaatccctgctttccagggggtccctagaggaaagcaaaagtcagaggtgaagtccgggcagcatctctgaggctccctggggaggcaggtgcagtgaagaggccccttccacagcctgaggcccccaggtgtgtccagcccagctctgtgtgagaaaggagcgcagcctccctgcccagctggaagggaaaataatgtcctctggggcatggccttgtttaagcatgttggctgggcccccatcacagatgaagagaggcgagaagtcagaatgagagggccagtctgtggcatactggggggcctggaaagacctggtacccaggagatgtttgtttggaatttattattatcattattattgttgttgttgttgtttctttttgaccaggtacagggtttaaaaaaaaaaaaaaaaaggtaaaacaaatctcactcccatccttggcctcaagtctctaattcctctccccaggacaacagggttaacaatttccagagacagcccgtacatagaaggaatgtttactgaaaaaaatgaagaggggtcagggcaaggcgaggagcaagaagcacccccaaggaaacagagaagaccagtacaactgtacctctttgccagctgcaccatccgtaccaggttcgccctggggagtagagagcaatggagacatgaggagctccaacccagtttggtgtcagatgcctcactttgtacatggggcaagcccagccccctgttccacccagaggccacgatcctccagccctcaccctctgacaatctgggcacaggccgtggaaacttagacccccaccccatactccagcgtgatcccagagccccaacagctcccagcccccgtctacaagagctttacaagggaagaacagaccgtgcctgccttgctgtgtgcttggatcctggcaccttgcacactccctggctctgaatctatgttaaacgtttgctgaatgaacacatgaacagcctgagccggccccctccctgagaccagcaaggcagcctctcttctggtggctgctggggaagaggactctgattgctaggcaagtgggagattcatccaggggccatggaggctcctgagcctgcaaggagggaggcagggtccttggcaggaatcagagcgaataggcgtggtgagactgggcccgcctggcagatgggctgactggagtcaaacaccccagcccaggccaccagccccacggtcactgctgctgccccccagaaaaagtctgcgttgatggaaagcatcctgatgggtcccaggagacctgggtccctgcctctgctctcccaggagacttttcatccctgaccctggcaatcagttgcacctgttagggttcacctgtctggaacttttgagagaggtagatttgcagagtggctaaggacatgagttctggaatcaggcaggctgggatcaagtcagagctcttccactcactagctatgtgactccgagcaacctgcctaaccttgcggagcccccgtttcctcatctgtaaaatggggacaatcagatccactaaatggggctgcggcacagattaagataaaatgcacagcaagcacttagtccaccattcggcacacatcggtgaccgatatatcagcgctcttagtgttaaacgtgagctgagaccaagtcctggtttccgaggacctcaggaagttacagtaacagcactgcatttctggttcctgacatttagcaagattttctgtggttactgacaagctcccctggggaaggggaagaggcagaacagggacacgtagccaaggggtctgcagaaggttgatgctgaggcaccgtcatgggcagtgacctcatgtgcagcctggcacagcactgcagggcctatccttccaaattcagcatgatcctcaggcccgaacgccacgctgccatcctgccatgctgacagcctctccttccttagagaccccagatatgttgtgctgtgctcaacaggccttgagccaattgactctttccccctgggctatgctgtagaatgtgggatcttactggggggccagggtgtccaggggggccgggctggcctgggaggcctgcaaggcccctttctccggtggctcctcggtctcctttcagaccctagagaataggaagggggacagtgagaggggaggaaagcaggcaaagtggactcccatatagccagagacagacaccccatcgtgtgccagggactacagggagaggtggcactgcctgaacttgcagcaggactctgagatgacctccagccctctccaaagccctctgccacatcctggaaggcgagatctttggaggcaggagaggctgacaccagggaaggaggggatgagacaaactgttctccatccccccagcttcctctgaatggagcccacagtcaagcagggcaaaactcctgggagggaggaaggagtggagcatgttactcaccactgcagagatcccagctggtcctggctggcctggaggccctggtggcccctaaagagagatgagtcagtgggatagaaacaggttctaatagtaagacccctgggaggcacagggcctgacagcagaaacaagctctaaacttcagcagctccatttcctctggaaaccttccttcgctctggtcttgcacttgagcttcggacaagatttgcgcccagagctgaggcctgggggtcctgggcacacaggaccctccctccaacccaggctgagtggagcatctggggctgtgctgagggggatgatctgaaagccgtggccagaggccaagtgcagaggacaaaggcctgggggagttactccctggcctaggtggctactgagacccttgcttccctaaaggcagtctacttcctgctgttctatggaggagggaagaccagaagctgggggtccgtgtagcagggggtgaggggcaggggcttggcactgaccccgacatccatagtgacaaggagctaacacttgctggccaacactggagcgcacgggactccaacacccagacagtccctgctgctgcactagggctgcgtctgaaatgcccttccctagctctgatgcctacatcatgcctctgtggtgcaaaagatcacctccctgatcagagtgacaccttctctgaacccccggggcacttgggtctctcttatagtgcttccctcaacacccccaggtggcacgttccagagccatagcctctgttctattcatctccagtctcctggggtggaagtgtccagcacagagactgccacactgcaagacgaaggggctggacacacggaagagagaggcggaaccttgcaccccctcaacctcagccctattgagtctccaatggggccacgcttctgagtgcacctccccgtgtcatctgtaatgtgagggggaaccaggcttgatatggcattcccaatccagggcctctggaccccttgagatgcataaaaatagtgatgggggcctgagagttctttttttttttttttttcttaggtcatgaactatttttaacatttccgaaagcctcctggaaattattatgcagccagccacaacagggctgcaacaaaatgccagtatcttcgcttttctctggagtcccatcagctcagtgccgtcacactgatcaaaggcactgcctggcagtcatctatgttagtgatgagtaaagtagacaggaaattcattgttgcttgataaatgtcctctccaagtcaccccatcttgggaaacacaccacctatttacccagttgcccaagtcaaatgcaggagtcacccctggttcttctctttctgtcactctgtctccccaaccccaatccagctcatcagcaagtcccccaagcctggcatggcacaggggctccacaattatttgttgactgaatgacctccatctgataagtgaacttgaatgtgcccagaaaataagaaaataacgaaaagcctggaaaccacagaaggagtggcccccgtgctcccacggctggggcagcccctatggcaagttctctcaggtcatgacagcctatgcaccaccaaccaccccgccaaaatgctaactcttatggagacagagacaaaagtggttcaactcacaacgtgtcccgggggaccgggtcttccctggggtcccatggcaccaggttcaccctgcaggagccagaaaaaggaaaaaatgacactgaaactgacttgcttgcaccatgtggctgtcggatgggagggggctgggcagaatacatggtaatgccaatggccaaaggagctgggccaattcccagcctccagacccaagtttcccggagagttaggtagagaaggcggatcctcagcctgagcaggccaggccctgcctttttaggttggtgacccagtaacctccagggagcagaaccagttacaacccttaataggagggagaaagttcaagacgtgcagtgttgggtgacacccctcccagaaggctgaggacagaaagcagccactttgccagtgagcaggaagaagcggctgcatcccagactctgcagagtctgaaggcaaactgaaggcagccatgtggatccctggccctcacctctgcgccaggccggccagtgctgccagggggacctggtttgccacagtcaccctagaagagagaggagcagctggagcttaccagaccttcacttgacatccctaccccaagtcaacctcacatcagagggaccctgccacctgccccagctttggccagaggccctctgatgccctccagctggtagacagagaagccctgacccagtctgccaggcaccagtggccccaggaggctctgatgctgggatggcctctctgcccaggataggctgccatgtatgcctgggggcaagccttcaggagagcagagataacctgcttggcagaggtcaccagcccttaccttaggtcctgggaggccaggatgtcctgttttccc

SEQ ID NO: 9652 - DNA, 347 bp, Homo sapiens
tcgtagtgtccctagaaggtgacccgtaatgggtgtgctccagcaggatgactggtggaggtgtgaaccccacatatgggtgcctctcaggaggatacccttcaagatagataactatagagatatgccctccagcagaggtgactctgggagggtatctctcaggtgcccgtcgctggtatgccctgccatggtaactgactggcgtacacctttaggaaggtgatggatcagatgtgtgcttattctgaggggcaactgtcaggagaggtaccccagatggatgctgccaccaaagtgtatcatatcatcagatacccaacacttacctgtccaagtcccccacc

SEQ ID NO: 9653 - DNA, 53163 bp, Homo sapiens
attgtaagattgtgaagatatataaaattgatgaattaagagaaattatgccactttcctatagtttctgtgttctgtttattgtatggtgtattcactcttggaaaatatgtaatagttgtgtatccagaatatgtgtcttcacctgaatatttaatctttatatttacaaaaaaataagttccacaagatggacaaaaatggtccatgatatttagcttaaattgtaaccttttgttgtgtatataaaacttccttggaagaaaataaccttattgttttcttaaagctaaacagaataggattggtactcattaattatgtcttgcaaatattttctaaaaattcaaccactctcctaaaatggtgtttaaatattttgtagggcagaatatgcatattgcctgttagcaagtaataattcattctcatagagaaatgggtttttacccatggaagtaatcttttttttttcttttttttttttaattttttttttaatatactttaagttttagggtacatgtgcacattgtgcaggttagttacatatatatacatgtgccatgctggtgcgctgcacccactaactcgtcatctagcattaggtatatctcccaatgctatccctccccactccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtaatcttttaatgatattttcttattatattgctacaggcaacatcagtagaagcctatctagttacactaaactaaagatcacattcaccattcttacagccaagtggttgctggtcccctcataacttttagttacttaagttgagtaaatgtctaattgtttacaaactaaattgactaaataaggtcaaggataatgtttttcattgattaaccatttattatacatataatctattgaatataaaaagattcaccttgaaataatatttgactatataggtacatatctgtaaaagatgaccaccttaactaaatcagattttacatttataaattttatatttaattagtcaaatcaatttttaaatcataactccttaatctcataagaagcaataaatgcataaagcattatattaaaataccagggttacttatgtcattgacagggaaaagactttgtataaacaattatgcaccatctatttttgtactcttactcatgatccatttaaaagtctactcagctctagattagataccagaagaccctctaagtaactgataactgagattcgggaccatgtcttgtttgccattgtgcccttggaatttaatacaagtgcctaacccacagtagggttgattgattcactgattagttttactgccatgtgcctataactataggttattctctttccttttctatgttgtgtttattctatttattctctacaatatataaaatgtatttgttctctacaataaatgtgtttattctctacaatatataaaaacatattggactactattacataattaaattactcttttatttgcttaaagagggtgattattttttcacttaccgttccactgagcagcaaccgggactggtcaatagatggaaatcaatcccaatttagagacaatacctggccctgctttgacaatcctgtttcacgtttgccagagtcatgcacttccttacttttgtatataggctccagagaagtttccattaagtgaaacagctatattaattttttaaatatatctttatttaaataattggatgtctggactttatcccaacgtttatttatcaatttttatagttgtcttccaatatatcttttatcatttattttgtaacacattctttggaggtctgtgatttatagtactatgataattcccttattgactcattattcaaagttagatgcagtcttctaatcttagctatttggcataagaagcaatagccaaggggatgtatcctgtactttatgtttaatttgttcttcagtaactacatatcatttatatcagattatcttaagtattaacaggattcacctggatcaaattctccagtgaaagagcttgtatcggtatttctagtaagtgccgacaaatgagatacataattaaccaagtttgggaatcactgagctacatcaatcattacactagtttccctttgttgtgctgaacatagaatcataaaatactaaaggtaattttcacatgcttcctttccctgctgacattgccttatcctgaattgctaaaacaagcctctcgatgtcacggaattaattgccttagttcatcataaaggaaacattgtttaacgaactgaatcttagctgagaagttaccacaacagggactcaaagacttattttctttagttttgttgtgtaatcagcaacaaaggatctgaagataaaactttttccacaaagatgcaaagtgtttcaaacattaattgtatgtgtatgtgaccaatttgagatttcactattgatgtttcacaatatggaaggaaggtaaattatctgtgatgattattctctttcccatcttatgttttttgcaagtctcatcattgctgatatataaaggctgatatattcattttacatatctaataaatgggatttaagttatttttttcctatggacagtagcaaattgcccttagccagtcacactatggtcaccagtgccctacttctaaaatgacaaagataaagggagccatatctggctaaataagttaattagccataaggaatggactctatgactcagtgccaccaaccatcacagaccatcaccaattacacactccatattcatgaccaagagtttcgttttcaggccattatttttgctaatctgcccactgtgtaaaataagtagcttggtggctggcaagatggccaaataggaacagctccggtctgcagctcccagcaagatcaatacagaagggggatgatttctgcatttccaagtgaagttcctggttcatttcattgagactagttagacggtgggtgcggcctacagagggcaagccaaagaagggtggggcgtcacctcaccagggaagctcaaggggtgggggaactccctccccagccaagggaagccatgagggaccatgccgtgagggatggtgcacttcggcccatatactatgcttttcccatggtcttcgcaacgtgcaaaccaggagattccctcgggtgcctatgccaccagggccctgggtttcaagcacaaaactgggcagccgtttgggcagacaccaagcttagctacaggagtttttttttatcataccccagtggtgcctggaacgccagtgagacagaactgttcacttccctggaaagggggctgaagccagggagccaaatggtctagcttagcagatcccggccccacagagcccagcaagctaagatccactggcttgaaattctcgctgccagcacagcagtctgaagttgagctgggacactccagcttggtgggaggaggggcgtccaccattactgaggcttgagtaggtggttttcccctcacagtgtaaacaaagctgctggaaagttccaactgggcggagcccaccacagttcagcaaagcctctgtagccagactgcctctctagattcctcctttctgggcagggcatctctgaaagaaaggcagcagctccagtcaggggcttatagataaaactcccatctccctgggacagagcacctgggggaaggggcagctgtcacacagcttcagcagacttaaacgttcctgcctgccagctctgaagagagcagtggatcttccagcacagcgctcgggctctgctaagagacagactgcctcctcaaatgggtccctgacccctgtgcctcctgactgggagacacctcccagcaggggtcaacagacacctcatacaggagagctgcagctggcatctggtggtgcccctctgggatgaagcttccagagaaaggaacaggcagcattctttgctgtcctgcagcctccactggtgatacccaggcaaacagggtctggagtggacctccaccaaacttcagcagactgcagctgaggggcctgactgttaaaaggaaaactaacaaacagaaagcaaaagcatcaacatcaacaaaaaggatgtccacaaagaaaccccatctgcaggtcaccaacatcaaataccaaaggtagataaatccacgaagatgaggaaaaaacagcacaaaaaggctgaaaattccaaaatccagaacgtctcttttcctccaaaggatcacaattcctcaccagcaagggaacaaaactggacggacagagaatgagtttgacgaatcgacagaagtaggcttcagaaggtgggtaataacaaactcctccgagctaaaggagcatgttccaacaaaatgcaaggaagctaagaaccttgaaaaaaggttagacgaatggctaactagaataaccagtttagagaacataaatgacttaatggagctgaaaaacacacaagagaacttcgtgaaacatacacaagtatcaatagctgaactgatcaagcggaagaaaggatatcagagattgaagatgaacataatgaaataaagtgtgaatacaagattagagaaaaaagaatgaaaaggaatgagcaaagcctccaagaaatatgggactacgtgaaaataccaaacctacatttgattagtgtacctgaaagtgacagggagaatggaaccaagttagaaaacactcttcaaggtattatccaggagaacttgcccgacctagaaagacaggccaacattcaaattcaggaaatacagagaacaccacaaagatactccttgagaagagcaaccccaagacacataatcatcagattgaaccaaggttgaaatgaaggaaaaaatgttaagggcagccagagagaaaggttgggttacccacaaagggaagcccatcagacaaacagcggatctctctgcagaaaccctacaagccagaagagagtggggggcaatattcaacattcttaaggaaaaacaacccagaatttcatatccagccaaactaagcctcataagcaaaggagaaataaaatcctttacagacaagcacatgctgagagattttgtcactaccaggcctgccttacaagagctcctgaaggaaccactaaatatggaaaggaaaaaccagtaccagccacttcaaaaacataccaaattgtaaagaccattgacagtatgaagaaactgcatcaactaacagccaaaataaccagctagcatcataatgacaggatcaaattcacacataacaatattaaccgtaaatgtaaacaggctaaatgccccaattaaaagacatagactggcaaattggatgaagagtcaagacccatcagtgtgctgtatttaggagacccatttcacgtgcaaagacacacataggctcaaaataaagggatggaggaatatttaccaagcaaattgaaaggaaaaaagcaagggttgcaaccttcgtctctgataaaacagactttaaaccaaaaaagattaaaaaaagataaagaagggcattacatgatggtaaagggatcaatgcaacatgaagagctaactatcctaactatatatatatgcaccaaatacaggagcacccagattcacaaagtaagttcttagagacctacaaagcgagttagactcccacacaataatagtgggagactttaacaccccactgtcaatactagatcaacaagacagaaaattaacaagaatattcaggacttgaactcagctctggaccaagcagacgtaatagacatctacagaactctccaccccaaatcaacagaatatacattcttctcagcattacatcacacttatcctaaaattgagcacttaattagaagtaaaacactccgcagcaaatgcagaagaatggaaatcataacaaacagtctcccagaccacagtgcaataaaattacaactcaggattaggaaactcactcaaaaccacacaactacatggaaactaaacaacctgctcctgaatgactactaggtaaataacaaaattaaggtagaaataaatgagttctttgaaaccaatgagaatgatgacacaacgtaccagaatccctgggacacagctaaagcagtgtttagagggaaactgatagcactaaatgcccacaagagaaagcaggaaagatctaaaattgacaccctaacatcacaattaaaagaaccagagaagcaagagcaaaaaaattcaaaagctagcagaagacaagaaataactaagatcagagcagaactgaaggagatagagacacaaaaaaacccttcaaaaaaatcaatgaatccaggagctggttttttgaaaagattaacaaaatagaccactagccagctaatgaagaagaaaggagagaagaatcaaatagacacaataaaaaatgataaaggggatatcatcactgatcccacagaaatacaaactaccatcagagaatactataaacacttctacacaaataaactagaaaatctagaagaaatggataaattcctggacacaaataccctcccaagactaaaccaggaagaagatgaatccctgaatagaccaataaaaagttctgaaattgaggcaggaattaatagcctaccaaccaaaaaaagcccaggaccagacagattcacagctgaattctaccagacgtgcaaagaggagctggtaccattccttctgaaagtattccaaataatagaaaaagagggactcctccctaactcattttatgagaccagcatcatcctgatatcaaaacctggcagagacacaacaaaaaaagaaaatttcaggccaatatccctgatgaacatcaatgtgaaaatcctcaataaaatctggcaaaccgaatccagcagcacatcaaaaagcttatccaccacgatcaagtcagcttcatccctgggatgcagggctggttcaacatatgtacatcaataaacatgatccatcaaataaacagaaccaatgacaaaaaccacataattatctcaatagatgcagaaaaggccttcaataaaattcaataccctttcatgctaaaaactctcaataaactatgtattgaaggaatgtatctcagaacagtaagacctatttatgacaaacccacagccaatatcatactgaatgggcaaaagctggaagcattccctttgaaaacttgcacaagacaaggatgccctctctcaccactcctattcaatacagtattggaaattctggccagggcaatcaggcaagagaaagaaataaatggtatttaaataggaagagagaaaataaaattgcttctgcttgcagatgacctgattgtatatttagaaaaccccatcatctcagcccaaaatcttcttaagctgataagcaacttcaacaaagttgcaggatacaaaatcaatgtgcaaaaatcacaaacattcctacacaccaataataggcaaacagagagccaaatcatgagtgaactcccattcacaattgctgcaaagagaataaaacacctaggaacacaacttacaagggatgtgaaggacttcttcaaggagaactacaaaccgctgctaaaagaaataagagaggacacaaacaaatggaaaaacattccatgctcatggataggaagaatcaatatcgtgaaaataaccatactgcccaaggtaatttatagattcaatgccatccctatcaagctaccattgactttcttcacagaattagaaaaaactactttaaagttcatatgaaaccaacaaaaaaaaagctcgtatagctaagacaatcttaagcaaaaagaacaaagctgtaggcatcacactacctgtcttcacactatactacaaggctacagtaaccagaacagcaaggtactggtaccaaaacagatatagaccaatggaacagaacagaggcctcagaaataatgccacacatctacaaccatctgatccttgacaaacctgacgaaaacaagaaatggggaaggattccctatttaataaatggtggtgggaaaactggttagccatatgcagaaaactgaaactggatcccttccttacaccttataaaaaaattaactcaagatggattaaagacttacacgtaagatctaaaaccataaaaatcctagaagaaaacctaggcgataccattcaggacataggcatgggcaaagacttcatgactaaaacaccaaaagcaatggcagcaaaagccaaaatagacaaatgggatctaattaaacttaagagcttctgcacagcaaaagaaactatcatcagagtaaacaggcaacctacagaatgggagaaaaattttgcaatctatccctctgacaaagggctaatatccagaatctacaaggaacttaaacaaatgtacaagaaaaaaacaaacaaccctatcaaaaagtgggcaaaggatatgaacagacacttctcaaaagaagacatttacgtggccaacaaacatgaaaaaaaggtcatcatcactagtgattagagaaatgcaactcaaaatgacaaggccatagcatctcatgccagttagaatggcaataattaaaaaggaaacaacagatgctggagaggatgtggagaaataggaatgcttttacactgttggtgggagtgtaaattagttcaaccattgcagacaacaacgtggtgattccttaaggatctagatccagaaataccatttgacccagcaatcccattaatgggtatatacccaagagattataaatcgttctactataaagacacatgcacccgtatgtttattgcagcactgttcacaatagcaaagacttggaaccaacccaaatgcccatcaatgatagactggataaagaaaatttggcacatatacaccatggaatactatgcagccatcaaaaaggatgagttcatgtcctttgcagggacgtgggtgaagctggaaaccatcattctcagcaaactaacacaagaacagaaaaccaaacactgcatgttctcactcataagtgggagctggacgatgagaacacatggacacaggaaggggaacatcacacaccagggcctgttggggggtgggggttaggggagggatagcattaggagaaatacctaatgtagatgaggtgttgatgggtgcagcaaaccaccatggcacacatatctatgtgaaaaaatctgcatgttctgcacatgtatcctagaacttaaagtaaaaaaaaaagaattaaaggtcatcagtgtacaatgaaaaaaaagatggtggagaaatagtttccacctcttaatgggagaatagtaagcacatgcaggaattgaaggaattgatggcagccattttgcaggcaagctaccacaactactatggactgggagatttgagggaagtagcaagaaacattattttctaaccacctaaaaggtacaaacgaccactgagggttcactttttgttcattcctcaatgcttcttttcaggtcctctctactgcatagagacaaatgtaagttttgaagtccaaaataattgagttgcttaatgctataagaagttgcatttattcaaaatacaaacacaattcagcttttggtgggattttttatgttttattgtttgattattcactttttacctaccaaattgcaaaacttaaaaatcatattcaaaattgaagagtgtactataaaggagatattttcatattttatagttggaaatgtaaatctacaatactgcaatgtgacagtgagtgtaagtgacattaactaggccaagcacggtggctcatatctacagtcgtagcactttgggaggctgcagtggaaggattgctcgaaaccagaagttcaagactaacctaggcaaaaaggcaagaccttgtctctacgaaaataaaaatttttaaataaaaaattagctgggctgggtggtgcacacctgtagttccagctattcaggcagctcaggcaaaaggatcccttgagcgcaggagttagagactgcagtgagccataatggtgcctggactccagaacaagactctatctctaaaaaaataaataaataaaagaaagatatcaactaaaaaaaaataagtaactcgttcgtatatatcaacagtgcaactttgatgcagtagcttaatgctatttcattcccatctttctctaaaagaatgattaaagtatgtactgtttatacaacattatcagttattattaagtgaaaggccattgacctttaatattatcagagccaagtggatttaggccagctctttgatatctaggccagctccttgactcacagtagtttgagttttctgtttcaacactcatgaagtaaaaagtaatttttaaaattcttaaactttttcagacagccaaaatgttcatcagttatttgaacttggacgtaaacagaatttccagctatttgaatcaattaaactgtctgttaaatctattttataggttacaacctaaacctatcctccaacccctcagtacgtgtgtgtgcactgcatgcacacacatatacactcacattttagcttaacttgctgccttaaataaggctatagttggtatgaaactttatatcactaatgcatagataaatgcaggtagttaaaatagatggcataaagagaaatattcttacagtaatctgtaagtgtatctttcagacctaaatcaccttagaaagaaatttcacttctaaatagatcataaaatgtgtttccagtgatatgagattcagcccttcttctttattttatttatgtattttgagacagagtcttgctctgtcgcccaggctggagtgcaatggcacgatctcagctcactgcaacctcagcctcccaggttcaaataattctcctgcctcagcctcccaagtagctgggactacaggcatgtgccaccatacccagctaatttttgtatttttagtagagatggggtttcgccatgttggccaggttggtctcaaactcctgacctcaggtaatccacccgccttgggtgtaatccctcccaaagtgctgggattacaggcgtgagccaccgcactcggccaacctttctttttaaactaccctttaagatagcactggcaacatcttgctgggttacagtgaagaggctctttttagttcaatgaaaggatgataatgattgtcatgaaagctgttgaactgggcatctatgaaaagtggttgtctccctactaggggatgctgtgtgaaaataaactttggttatttcatcttgattgataatttgttgaatatctgctgtgttcatctttgagtaacaaaatataattcagggatattatttgttggtgtagtgcatagctatgtagtatatttaaaataatataaaatcttaagaaataagtatctttattatacttgctttacagatgagaaactgaggctaggatttaaatgatttatccccaaatcactgatttaaattctgaccatctgactctagaaactatccttttaaacagcatggggtaggtgtggagaggaggttggtattgaaatgttatatctgcactggaatctaggaaaagcagaattatgagatctcagggaaagtgaggactgggacctgtctagggacagtccactccctcaattccaactccctgtctctagtttctcgtttttcttctgccccattcttatccctgcctacttctttctcacctttatgaaccattcctatccctaagactaaatcttctggcttctcagtccacaactatctccatttctcagattgtctatttcaaagtatcaagcaaagaatctaccttgtgcagctcatcttttaatcttatacatgacaaagacaactgtgcattacacatcactttgggtcaggagtctacctctgacctaagaagctgttgtcaggtagtatatgccggttgggagtaatgaggagaaactagcacagtctagagagtgatgtgaaagcaagaaggcaaacacaaatcacaaccagtagttccaaaaaaagactaatgagactgggctggctactgattattttcctttgagggaaaaaaaaaagagattgagagaggaaaaacctttcctctatcacataagcactaaaatgagctgttgtctaaaacccttggcctttcgtctcatgttctctcaacctatctttgttccagagaaagggaaagtctaaagaaggctgtacttttcttttaaaacatgaaaacaaaacaaaatctcttgccataagactccaaatattgactttttaagcccaagtttcatttctctatgggaattactgcataacacatagcttacgagacattttctcacaacttcccactcaaaacaagcagtaacaccctaccaccaccactacagaattgcactatccctaacacatatgatcattacaagcacattttggacagaagcagccatttttcccagtgacctatcacttgtggacacttatatgtgccaagcacttggcccaggcagcacaattcctatgtccttggcaaacaggaaggagaagacggcaaaaggcagtgatttggggtgacaagttttcactagaaaataggagcgtctcttctttattcccacttgactgaacttccagcatatattcaatgtaacaaaaacattatattggaaacacaaggcatccaggcctttggccaaaaatgtaggggaaaaaaatagaaagcctaatatttcatgggaaattcttggcttaaataatattttaataaagcttagctacatatgccaataaagcatagagatgacatactgatttatgatttaaatatcattatagtctctgtgatgctggtatcattttgtatcaaacaatatgaaagaggaaaaatcactggggaaaagaagagaagagcaacatgaaatcaattgagatatcagtagaatgtttattgcatataccatctaattaaaaatttgctgtaagggtaataatagctaacatacattgagcagatatgatataagccttacaagtataatctcttttgatcttgaaaaaatttccctgaggtagatattattatttccatttaataattgagattcataaaggctaacttgagcaaggtttagcagaactcagaggcaaactcaagcaatccaacttcaaggccacactcttagtcgtgtgctatactagaataaagattaatttagtgaagtcaattatttgttttgggaataaatgatttatactgtatgtgttaatactgagtgtcaacttgactggattgaaggatgcaaagtattattcctgggtatgtctgagggtgttgccaaaggaaattaacatctgagtcagtgggttgggaaaggtagacccacccttaacctgggtgggcaccatctaatcagttgttagcacagccagaatataaagcaggcagagaaatgtgaaaagactggactggattagcctcccagcctacatctttctcccgtgctggatgcttcctgccctcgaacactggactccagtttctccagctttgggacttggactggctccttgctcctcagcttgcacatggcctattgtggaacctcaccttgtgattgtgtgagttaatagtccttaacaaactcccctttatatatacatctatcctaatagctctgttctctaaagaaccctgactaatacagtatgtgacatataataaagaataattatgtgaatctatgtagaatactattgaaaagagaaatggaccaggagacctgacttctagtcttgattctatcaattgaatatatggccttggatttatcatttaaaggctgggtccccatttcctcatttgcaaaaggaaaaccaaaagacatgacaataactaccctgttggcctcactgagtttttattaatctcaaataaaatgatgggaaaataactttataacttgaaaagcacattccaatacggaatgttagtatgagagcccactacattgaccataccttaatgagcactacatgagatttttaaaatcacagaataagtgttttatttcctctaaaaacaaattgactatccaactttgcaaaggtgagatcgtatattcaagataagaaattgaataaaaatagctccagaatattgataccctagaggtcctggaaagggaaaatccaaaatcagtctgctggggtacaatctagatcccatagggaggaaaaaaaaacaagaaaattaactcacattcaaaattaaaaccacatgagaaaacacataccaagattggaacccagacacaaccaataggaatattagcacaataactagaaatcattataaaacaatctataagaagttttaaagtatgtatgtttgccagtaagcatgtgaaaatgtgttcaacatcattcctcactgggaatgcaaatttaaaaaactatcccctaaaatggctgaaatgacaaggactggcaataccaagtggggtgaggttggaactctcatataactgcagaagggagcgtgcatggcacaaccagtatggaatactggcagtttctactaaggctaaataggtacctataccaggacccaacaatttcatgctagggcatatatccaggtgaaatgaatgcttatgcccacaatagatcttgtacagaaatgttccatagcagctttatttataatagtcaaatttataatagtcaaacaaacataaataacccatatgcctgtcaataggagaatggataaataaatggtgttatattcacaaaatgaaatactattactggaatataaaacaacctggccacatttcacagacactctgttgagtgaaagaagcaggtactaaagagtacctactgtgttattccatgcatacaaagctcaacaacaaacaaaacaaactgctgatgaaatgccataaaaaggtgagctctgctagggagcaattacagtctaaaaagggcagaaagaaatcttctatggtgatagatatgctttatatcttaatatctgatccatgtggtagttaattagttgtacatataggtttttaaaaggtggttaaaaaaaatagaacttctaggaaaaaaacctctaaaattattattaaaattcagtggatatatcaaaccataattaagcttagatgatgagagaattatttccattggaaacagatctagaatgcagtgcagaataagtagataaaaaccatggaagaacaaccagaagatatggaggataaaatgaaaaggtctgaactagggatctcagaggagagaaagagaaaatgaggagggttcaaagagccaaaaactattcccaaaagaagacatttatgcagccaataaacatatgaaaaaaagctcatcatcactggtcattacagaaatgaaaatcaaaaccacaatgagataccatctcatgccagttagaatggtgatcattataaagtcaggaaacaacagatgctggagaggatgtggagaaataggaatgcttttacactgttggtgggagtgtaaattagttcaaccattgtggaagacagtgtggtgattcctcaaggatctagatccagaaataccattgacccagcaatcccattactgggtatagacccaaaggattataaatcattctactataaagacacatgcacacatatgtttattgcagcactgttcacaatagcaaagacttggaaccaacccaaatgcccatcaatgatagactggatagagaaaatatggcacatatacaccatggaatactatgcagccatcaaaaaggatgagttcatgtcctttgcagagaaatggatgaagctgcaaaccatcattctcagcaaactaacacacgaacagaaaaccaaacaccgcatgttctcactcataagtgggagttggacaatgagaacacatggacacagagagggcaacatcacacactggggcctgtcagggggtggcggttaggggagggatagcattaggagaaatacctaatgtgtagatgacgggttgatgagtgcagcaaaaccaccaaggcatgtgtatgcctatgtaacaaacctgcacgttctgtacatgtatcccagaacttaaagtataataataataataaagaaattcagactcagatgatttcaaaattattctaagctttcaagaagcagctaatccctactctatatacattatttcaaccgatggagaaagaatacacaccaattctttttacaaagactcataacatttacccaaaaccagacagagaaaacacagaaaaaaataatacagaccaatctcattcacaaatatttatgcaaaagtcctaagtaaattgtttaacaaacatgatccagcattatattaaaataacagttcacagtgaccaattggagtttaacctcaggaatgtaaaaatagtttaattttttttaatctagtgacttaattcaccatattaactggtcaaagaagaaaaaaatagataaacttggtagatgctaaaaaggcattttgtgtaattctttatccatcactgatttaaaaaacagaaaagtagtaaaaacataccaccttaaagtgataaatatataaattatatattctggaagcattttattaaaatcactaagaagagaaagcatgcctgttatcaccatttttgtttatcaataatctaacaatactaacaaattcaggctaagaaaaaataaaataataaataatgaattacatcctaattattaaggatgctgtatccaagttataattatttttaaaaatattgttttagggccaggcgaggtggctcatgcctgtaatcccagcactttaggaggacaaggcagggagaggatcacttgaggtcaggagttcgagaccagcctggccaacatggtgaaaccccgtctctactaaaaaaaaatacagaaattagccagacttggtggcaggtgcctataattccagctacttgggaggctgaggcaggagaattgcttgaacctgggaggcagaggttgcagtgagttgagatcgcgccactgcactccagcctgggcgacagagcaagactccatctcagaaaacaacaacaacaataacaacaaaaaatatatatatatatgtagttttaggtgtcctgggcctgtgctaaatcctttacatactcaactcatttaatctatacaactctgagaggtagatgttagtccatttcgcagaagaggagattgaggctcagagtcgttaagtatgttattcaaagtcatcaaccaagtaaatggcagaactggcacctgatctcgtctttctgactgtaaacctctgtgaacttaaatggaaggttatactatagctcatgcatctcccataatttctcaattttttaaagaaagattgactttcaaatccataataaatttcaagaggagatcattttattatcccatcaattctaacaaaaaatgaggtaatttgacattttaaattagacacaactctcaaacatgtaattccagtgtgaacttgtttagaaaaaatgacctggtgaaagtttttctggcacagaacatttttaccttaaaaaaaaatcatttaacagcagaaaaaatatcctggcttcattgggcccaacaagtctaaatatcactttaaaactttcaacctctataatcctttctatagctgacagttttgaaaggtggcaataaggacctgctctacagagagttctggaaaatgtcaggtttctctttccaagcattgcgtgagtcactaattttggcaaaacataatgacatgaaagcatagcaatggatcaggtgatccttgggaattgctttttccctgagtttcagaaatcctgtgaagagttcctgtgaagaattcctatggcaggacagatcccaggctcacgcgaacttacctttctttggcatgagaacatgaaagcataatttcaggccctgaaaaaaatcaacagtgacagccactatttctcatcttctcttgggagagggcctactagctttatttataattagtattttgtagcctaccagtagaacataatcagcatgggtactctttctttgatggaaggaactacttttctcttggaaacactattacagtaaaacacatgtgttgatttctgagtccttattttattaccagtatcttggttggctcctttttagtccccagtgtcttaattaagttcaagagttgaggagacggtagtacaagtattggttagttataatagcactctgagggttggtaagatctcaaaaatattcaggtctataaaatgataaaataaatctgtgagctgtagcttttccttcctacccccacagcctgctctgagaccttcttgaccatcaccaaactaaaaccagccctaagatattaatgagttgatatttattaagtacttatcacaggccaggaactatcctaagcatcttatattatctcatcttgccctaaaaataattctatgaggttctaatacctggctgggcaagagaatctccaggataacttttaaatgtgctttattttattagaagtgtttataccttttcattaaagatattttaatttctgggccaaagatcatacttcttattctatccttgctcaatagaagtctggtggggcatgaaatcatattaccaggtgtttctcgtgcagctggaccatagttggacaatcatctccttgagatattgtctagtaagaaaagcacaggatttggaatcagatgttctgagtctgtcatagctttctacttgcttggtaagtgactttggaaagtcattttgctaaattctaatcaattcgtgtgcaaaatgagaaaaataacctaattttcatgcaactgtctcaaggattagggtcagtgattttcataacctagttacctggcagactcccaatccttattcattgggtaaatggagagaacagtgaaggcacttcccagttttcccagctcttcttctgcctttcctcttatccatctgctatactgattttcttattgttcttcaagcacatcaaactatttcctgcctcaaagcttttacacttgctcttgggctgcctgaagcactctttcccaagttgatcatacagttgattctttattcaaatgtcactgttttaaagaggtcttttttgaaccctatctaaaactgtcatctctggccctagttacttttgatccttatctcaatttattttctttatatattttaccactattaataattatgtaatgtattacttgtttgctaacagctttctccccaagaatgccttggagcagggatgttgttttgctcacctagatgcaaatcaaagggtagttattgttgtgagtgcctcctttcctgacctttctgattcacacctgtgagcttgctaaagtatgaggagctgagcttgcaaagaagaaatggggtgaccttatttaaaacagagtgatgcttttctgcacataaatagatacatatctcaaaaagaaatgttctccgaattcactggaacaaataactgagaagagttatactgtcattcccattccatgataactccaaaaaagtaagtttataacatgctgttttgattactagtttatgtaacaattttattaagttgattccaaagcaatatgttccaaagtggtttatacgaggacactagtaaagcagcatactaagcaaatagaccaaccattatttgttcagctaacatgactcgtttccattgccattttgaagaccctccaaatttttaagtctaatatggctcaggaaatccaagagtttgaagtctacaagtcatgtcaaaggcaaagtcaacaactggaagaatttcacccttgctctcaagggtactttcagaaacttcactgatttgcatttggtaatcaaagcagcagacaattaggaaaagcatcaacctaatattttctctacttgtctaaaggcacttgacaagctttgtttcttaagagaatgagaatgtcagaaacccaaagaaaaatgctcatagggtctaaaaggaacctggcagatgctgacttacaactgaaccaaaatcttttaattgctttttaattgcataaatttctgcaacatgagtaaattctaacaggattcctgcatactcaagaaaattataatagtaaataaaattagctgtgttctaaacttattactgatatcctctggtagtgtgcaaattagtcttcactcctgaaagaacaattaagaaaattattgaacagttaagaaaatatacctaacttttagtggacaacagcatatagtgattgaataagcagatgaataaaataagccctaagtagtaaatgtgctcttgaaaattaattgatttttttttgccaatttctcagccagaggcaaatttaaatgttcactgtttggaccataatatgagggagagctagaggtcagtcaataataaatatttattgagcagttactatgtgtccagaaagacttttgggggatagaggtatatgtcagttaagcttaaaatcaagttgtaaagagaaacttagctagcaaatgccagacaagtttaagtattgctgacttagagcaattagggaagttagggaagttgctaaagaagggagaaatggataattttgcaggagtgtccaatcttttggcttccctgggccatattggaagaagaattgtcttgggtcacacataatgtacaataacactaacgatagctgataagctaaaaatcacaaaaaaatctcataattttaagaaagtttacgaatttgtgttgggcagcattcaaagctctcctgggttgcatgcagctcgcgggccacgtgttggacaagcttgatttaaaggtagagcaatatagtaaagagaaaagtgagaataagaaaatttttgtagacagctatagaaacagacttcaaagtgaattccaaaagttcacatttcctatgtgggttctgagaaatagttgcaaaaccatgaagggtagagagagatgagagagaaaatgcaagagagagaaataccatgttttgaacactattcctacttcttttcatttgacaagtatttattgagtacctactcttgggatctcggaacaatttgagaccctgggtgtgtggtgatattaaacaatgtgctctcatgcagcttccacttagtgcagaaaaactagttgaaggacaaagacatacactgcttaaggaaacaatgtagaaagggaatacaaagaaaaatatatatctgtaatattcttatagcacacattctttaccatttaaaatgattactatttgttcttaggcctactattgtcaaacatttacttattaatttcttcaaatttgatctttattatgtgccctgattttgaatcaatcaagttaaattactgactaataaaaatatgacattctgttatgaaagcaagttgaaacgatttaaaattgcgtatttggaagaatacatctcaatgaaaaaaaagagtctgaaatatgtattataccaaaagaacagaattttcagagaattcagatatggatttttttgttgcaaatcttctcataaattctccacagtacttcagctcttctcattccaattttcttattatttttctgttactatgataaacatcacagtcacctctgacttttcccttttccaatattgactctgtataacattccttttgtatgtatttgtatagtgcccactgatgttacctattagcccaagacctcattccttctctaattaatgtaacagtttccagcaccctcttctgccagttacagaattttggagcccagagggactatactcaagaaatgcaacccttaaagccattatattctctgcttctggatcaatcctcttaaaacaggctcttattgtgtagttttctgatcaaaatctttccatggcttaccactacatactgaggactcctcagcttcttttgttgagcatttaaggctgtctatgcattttttaaggccccaatatgctttttcaactttgtatttttcattcattgattcaaaaatattttttgagcccatttataatttaaatggtgctagggccttgctacaaagatgaacaagtcacagccttgccctctagcagtccccagtttaagggagggggtacaggagtggtgggaatgggtgtgacgagtacatgaaaatctcattaagtattgagagtaggtggtaacagcgcctgcccagggagcactgaactcaagtgtccaatcctgctgtgtagccaacttggcttcatcaatgctgacgtgggctgtcttttctctgcttttctgtataccctaaatatatctaggcttacaaagcctagatcagatgccaaataatccatggatttttccttagtctcctactcttaaatatctctcatttgaattcccatgacattttaaaatttcctttcctattctaatcacatccctgcttgtattagagaatatctctcttactacaactgtctgcctcttaaaagcaacaactatgacatatatttatatatctctagacacataaacctaaaaaaagcttacaaaggtgttcagtaaatgttccccaggctaaaataatgaataataatgtgtacaaagtcaaaggtaaaatagaacaatggcgggaattgactatacaaactgattcttcatagacttgtaaaactattatactacataaattactgcaaaaattaatgacagtagaaaggaggactaccactaacaaactaggatcctgggcttacaggggttaaggagatctaaccacaaggagaaaaaaaaagttcttaatttgccttcattaaagactaattttaggtctttggctaattaaatgaatacattgtttatgctccatacactttcggctcgagtcttggaaaatacgtggaacttccaagaattaaagtttccattaacgcaagtgccaaaatcaggaggcttgacctgtgggaaaaagcacatttgtcttcgctggctccttttcaaaaagctatagatgtttattgtataaccttttttgtgcgcaaatgctgttttatcattcagacccatctagacagaggaagaagctgcaacatttcagaaagcaaccaattactgaggaccgaatgacctggccttatcagcgctgaagtgttaacggccgtccctgtttggggtaaaatttcttcattgggagccagtcagtggtttctttttttctttcttttccttaaggggccgggggtggtggggggcagtcgctgttttgaggtgtgtgtgtgtttaattccctgagaactggctttggctggtgaagaaatactttactatagtgggtttcagaacatcttccacctgtatctctcctagcaggtggaaatttaatgtaaataattgtgtgtgcccacagcttgaacgctttggaagaatattttctgacctctctgcttttattcagtccgaagtagcccagttatcatgaagtagcccagttatctacctagattacaaaataaaattaaaattaaatctccttacgtcagtgaacttggagtcagaaagttctctcccctgagcagagagccttttaaagacttgtgtgtcacgctggcggcagggggtcgcggctactggaaaggagctggctctgcaggtcccgccctcccccgggtcgtccctccctctggcctgctccctacctcccggggacttgcgctcgccccctccccgcccgccccctactccgcgacaacgtcggcttccgaggtctggcgtgcgtcaaagccctaactgggaggctgatttgtggagcatcgcccccccgcccccgcccccccagtccctcctccttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgtaagtttcaaagctgctccgggggagcggaggggggaggctgtccgtgttcccgtaaatgatttaaaatgcaaaacaccgcagaggcttgcagtgatggatggacttttcggggcacactccctactgcaacccgcaggctgttgtcttgggttttttcccccccgcaccttgtatatttgattccttcgttgtaaaaaaaaaaaaaaaaaaaagttttcaatttataatattatgatttccacaggaacctttttaactctttttagatgcaactcatacttctttcgcatttaaaataattcttataacttataaattctatagcacaccacttattataattttgtcagattacacgttatttagactgcgcaaggagtcatggcctttgcttacttctaaaaataacggaggaagaattttctctctttacttttaatattgctacatcatctaagtactttaataagtagatcgtgcacccaactggtcttaatcttcatgactgacgccacgtgctgtagccttgcactaatttacagacgcggttaatcgcagagaattatctttgagcctgctgtttaccggaaggctcctggttttgtttaactaaggctatgtccatatgtactcagaataagaaaaattgaaacagttctttttattaaaaccaagtaatttttctgagatcccagaactcaagcacaagctagattcatgtttgggttagtaaaaatcacatttttggttttgcatgtcacctcgcacatgtacagacatatccttgaatacaaggacccaagaggtgaggatagggtgggtttttaagtttttaataaatgtttccctcgtgcaggaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtaagaatgtagtgggatgaggcaggggttgaaaacagtagagaaaaaatgtcaaaatgccctttctcttatcattctgttatttaattgaaagtgaaataaagggtttgttttagaatcttcagaaacaaaaaagcacaataaagaacaacacctaacacagtaagtattttttaaatgcagctttatggagaagagtctctgaaaacctgagcttcagtcctttggactagccttgaaaatgttataccagttatcaaaaaaaaattgtaattcaaaggattacacagagtgctttactccaaaagcgcacacattgagttcagtatgaaaaagctgttgtccatagtttcagtgcccacaggtaaatatctctgatcaacaaaaaatattgtgctagtggacatttttcttgactcttctaacccatgacattttcagaaataataagaaaaaaatgggaaggccctagggggagagtgtcctagattaaaaatctactaaaaaatgaaataaatatcatcccttctttatcgagattatcataacatagctgattgcttgcactggattcagaaattaaaagttatgctaagattcagaactagaaattgctaatttttaatgacaattagtccaaaattttatggaaggggttatatagaagcaatttaattttgtactcttctttcaaagtttaaatagaatagggacaagatagttcttagattacctaactttggcttctttctcatatcataagtatctcaaagacaggtaaattgatttcagtgattcacctctcttgctttcacatggtttaagaacatttagttgaggtgatttctttgtttttttcggggggaggtggaaagagataaattatatcaattaccaagatgttcactgtgaagcaaaagagtagtaataatactggaaaattttccaaaacatttttaaaagaacattttaaattcacataattcacaaagcaaagaaacttgaaaaagcattatgataccaggaaactgtaaagaatgggacctctagtgaccctgaaaccttattaagctagcatatcactgcagaaagtggaccccagactgtgaacttgtccacccttccatttgctaaggaactacaatgccagcctttcaaggaggaaggcagcattagtgcgcagagatcacacaccacagatttcagctcaaattctgagcagcaaaaactgtattgaattgatctattgcttttaatattgattagatattattttcttttttcaaacttctcacaaactgttgtctcaaagaaaatgcagctggaaaacatagatcatcagtataccagatataaagaaaacacaatacttaaaatatccgttaaaacgttcaatagatactctaagatcaaatatcattatctataatatatatctttaagaaacttactggcactgataattggtgaatcattttcatatcaaaataaagttttaatctaaattatatgatactgataaaaagagaaaaaagaaatggtaacagcaaaccttaaaaatcttcattctctcccaatgagaatgtaaaaggtgactaataataattctaattctttgcatttttccctttgtgaattcaatgtccaaccatatcactaaaattggaaacaacatttttcattgaatattcaccagtatttccaaataatgtttgaccattcttctcttagggtgactcattttctcctccatgtattttctcctgcaaggagtctctttgactccatttaatatgagtcaaaaaatagaccaatatatttcctctttctcgatattatccagcctacctctttctgtaacagaacaaagaaacagctaaacacttttatctcttgagattgtttagcatagcaagtgtcagtaaaaagctgggtcttgtaccatatgtaatatttagaattcataaacaatatacaaaatgtggctcatgaatagtctcttaaaccattaaaacaaactatttgggatatttatcattagactgctctctgaggtatggatacattatcagaaatcagtgttgtatccataccccttctctggggtccatttttattcttgccatgttttggggctataccagatatctttttgtgggtagttagtgcaataggcaattactgtagttttccatgaatcattttagcaacaaaagagaaaggcaactttcgcacttcacttaaaagctaatcaaaagaataatccatgtattcttgcttatccctcataattttctaccaaagtgcactgtacataccaagtactcaaatgtttaaacatttttctcacctgctgtctgtagcattaataaataggtaatactttgagagattgctaatgtgtaggcttgtcttctataaagttagagaagtttgaaattgtggttgggggcaaagatagaactaatattgtttctatgaagaagccacagcagtacttgttgtgaaattaagtgttataaattgatagtaacaaatgtggtgcttcccatatgggagtaaatcagaatcccctgagaacttttcaaaagcatcttacccagatccaacctcagcctaccaaatcaatgtctattcactaagatagggagtagatgtgcaatttgaaaaagcttcccaagaaaatcctacaacttcttggttccttccctctgcttctttcacaggattaggccaaagtgagaaaattcaagttagtataatattaattacaggtataccttagagatattgcagttttggttccagaccattgcaataaagcaaatatcaaaataaagacagttacacaaaccttttgtttcccagtgcatataaaacatttatattatattgtaatctagtaagtgtgtaataccattatggctgaaaaatatacatatctcaattcaaaaaatattttaatgctaaaaaatgctaatgttcatctgagccttctgcaagatgtggtctttttgctggtggaggggctagccttgatattgatggctgctgattgatctgggtagtggttgctcaaggttggggtggctgtggcaacttcttaaaatatgacaatgaagagtttgctgcaacaattgacttttcttttcacaaaagatttatctgtaatgtgtgatgctgtttgatagcattttacccacagtagaacttctttcaaaactggagctaatcttctcaaaacctgccactgctttatcaactaaatttatgtaatcttctgaattctttgttgtcatttcaacagtgttcacagcatcttcaccaagagtagattccatctcaagaaaccactttggttgcttgtccagaagaagcaactcctcattcatccaagttttatcatgagattgcagcaattcagtcacatcttcagaatgcccttgtaattctaattctcttgctatttctaccacatgtgcagtgactccctccactgaagtattgaacccctcaaactcattcatgagaattagaatgaacttcttcccaactcctgttaatgttaatattctgacctcctcccgtgaatcacaaatgttcttaatggcatctagaatggtgaatcctttccagatggttttaaatttactttgcccagctccatcacaggactcactatctatgtcagcaatagccttatgaaatgtaaatttcttaagtaataggccttaaaagtcgaaattactccctgactcatggctgtagaatggatgttgtgttaataagcataaaaacagcaatcaactccttctacatctccatcagagcacttgagtgactaggagcattgtcaatgggcaataatattttggaggaatctttttttctgagcagtaagtctcagcagtgggcttcaaatatttaataaatcatgctgcagacagatatgctgtcctctagcctttatagttctacttatagagcataggcagagtcaatttagcataatactttggggctctacgattttcagattgatcaatgaccattggcttcaacttgatgttaccagctgcattagttcctaacaagagttagcctgaactttgatgctttgaagccaagcattgacttctatctagttatgaaagtcctgggtaacatcttcttccaatagaaagctgtttcattttcaacactgaaaatctgttgtttagtgcagccacctttactaattttcttagctggatcttttggataacttgctgcagctcctccatcagtacttggtgcttcacctagcacttttctgttttgaaggtggcttcttttcttaagcctcctgaaccaatctcttctagctttaaacttttcttttgcagcttcctcacctctcatccttcatagaaatgaagagagttagggccttgctctaattcaggctttggcttaggggaatgttgtgacctagttggtcttttatccagaccactcaaattttctgcatctcagcaatgaggctattttgctgtcttatcatttgtgtcttcactggagtagcactttgaatttttttcaaaactttttctttccactgttcacaacttggctgtttggcacaacaggcctaaactttggcctatcgtggcttttgacttgccttcctcaccagcttaatcatttttgcttttgatttaaagtgagagacagcgaatatttcctttactcgaacacttagtgttctttgtagggctattaactgacctaatttcaatagtgctgtgtctcagggaataggaaatcctgatgaaaggggaagaaacaagggaacagctggtcagtggaggactcagaacacacacatttatcgattgtttgccatcttatatgggcatggctcatggtgccccaaactaggggttcccaatccttgggctgcagaccagtactagtctgtggcctgttagaaaccaggccacatagcaggaggtgagcagtgggggagcaaacattacctcctgagctctgcctcctgtcacatcagtgggggcattagattctcataggagtgtgaaccctacggtgaactgcgaaggtgagggatctaggctgcgggctccttgtaagaatctaattcctgatgatctgaggtggaacagtttcatctcgaaaccatttccccccacacacaccccccagtattgtcttctacaaaaccagtccctgttgccaaaaaggctggggactgctgccctaaacaattacaataatgacatcaaatatcactaatcacacatcatggtaactgatgtaataataatgaaaaagtttgaaattttgtgagaattaccaaaatgtgacacacagacacaaagtgagcacgttttgaaaaaattgtgataatagactggctggatgaaggttgccacagaccttcaatttataaaaatgcagtatctgcaaaatacattacagcagagaagaataaaataaggcatatctgtatgtgaccttgacacagtcatttactagtttctgcccctagttctccctttaatcatttcagtattctccagaacacctagagtagtgctccccaacctttttggagccagggactggttttgcggaacgccaatttttccactgatgggggtgggggatggggatggtgtggggataaaactgtcccacctcagatcatgaggcattagattctcataaggagggataacctatatctcccacatgtgcaattcacaataaggttcactataccatgagaatccagtgcctccactaacctgactggaggcagagctctggcggtaatgctggcttacccactactcacctcctgctgtgtggcctagttcctgacaagccatggaccagcactggtccctggcctggaggtggggggggggggggttggggacccctgacttaacaaaattagatcatcaataagacacttttctttccaaatggaaaacaactcccttctattaaaaatactagttgtttggaataatgtgttttatactagtttttttagcactgtgctatttctatatgagacacaaaataagtattagctaatgaatatgattttaaagattataaataataaattcactcagtactcagtaccttccatatgactcaagtctcctaaacatagatacgcaataaataataaacatctacctggtagaaagttttacaaagtaaactgtgcctttgtgaaagtgaagtatttcgcaaggtaaaatatgcatatatatgaaaatatattaatcttttacacaaattaggcccatcactatgtgacctatgaaacattaatagaatgttaatagaattaggccttagcttaagggaacttaattaatagaatgttaatctccagaagtctggaggtagatgcatgcaagagagagagagactgttctaaacacagtttagaattaggcattttacaagtttaagttggctagtctttctgcaagcatttaatagtctttggtggaagaaaatgaaaagctcagcttggcatatttcattattcaaaatgtgacctgatggtgttcttttctgatatcattcctcacaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgtactcactgtagttttgtgattcctctttcacaaaatcatcccaagttaaaactcaagatgtttttagagccatgtaaaagagatgtcaaagtgataacactcactctgagattcctctctctcaagtctgtttgctccaaaactagcttttttttgctttgttttgattttatttcaggttttaaaatgtcctcttggtttttcaatctaagcctgacataccataaaaatcctataagcttttttttttaatcttcaatctcccatcttaaaactatacttccttcccagtagtatctgaatttaggcttggcatttatagatttagcatcatctcatttgctaaagtgagattttctatcaaagcttcatttaagcatatttagtgcctgcttcttcaaggaagggatgagacaggagagagaagtactaggttaataaactatatatgcttttattcttacattttatagctaaacatcagaaagctgagctattgtgaaatctttcacacagatttgggggtttgtatttatgaacattgaaataggtaattatgaaatgttctatcttaagactcatgattccaaccaggtgaacagaaactgtttatcacgtcattgagttaatcattcctgaaagggttctaactgttcctctgaactccagactcacagatcaaacaggcacctgaggctccacttggagattgaacaagcatttcaaacttactaggtctaaaaccaaatacttcattctcactcacaaaagctgccctcctcccagtctttcttccaatcactcaggcatcaagccatgacctggaagtcattcttgctgcctctttcataccctacatgccatccattagcaattacctctcggctctgccttcaaaatatatccagaatatgaccaattctctttactccaccacttccttcatagtccaagcaaggatactgtatatatgcatgcatctgtaccaattgtttgaatattaaaacatttctgtctaggttgctaaagactatcttaataaaacttaacccaacagcaactatggaggtggatatcagacctcaaagcagttctggaacagatgcaggttcccaccttcccaccccagggcagctgagcagacccagaggtagctgccacacaatccagcagtaagaacatggatagtgccttcctgctgctcagtagtagcccaactttgtagaggtgacacaggctgtgcaacaggtgatgtcaggacatagtggagctgagatgcaaaatttctgagtccagggtctagagaattccctggcaccaggggcaaagctagctatggagtacgggaagttcccccagccaccttccagctgcaactaaacgctgagtgtcaaggacctaatgactgtcaatataatgggcatgtcaacgaaaggttatgaggggctccctatgtcaagctgtggctcagacagggacatcatttagctagagacagccacaccaaacaaaaggttctatcaacaatttctaaaagtctgaaaatgttttagagagtattaaaatgattttctgacctatttttgctaaaacatatttcactgggtaagcaattttgagaactacatagttttagaagataagacggactctgtacatatatatgtgtacatgtatgattttgacttacatattgtgtttaaatattattttatattcagtattttggttctctgcttctaccctttcttccacctccataattcatacagcagccacaatatttttttaaatcacaagtcaaactacatgacacctcttcttaaagccctcttctgcctttttcattttcttttttttttttcttttttgcagacagagtctcactctgtcgcccaggctggagtgcagtggcacgatctcagctcactgcaacctctgcttcccaggttcaacagattctcgtgcctcagcctcctgagtagctgggattacaggtgcgtgccaccacgcctggctaattttttgtatttttagtagagccggggtcttaccatgttgcccaggctggtctcaaactcctgagctcagataatctgcccacctcggcctcccaaagtgctaggattacaggtgtgaaccaccgtgcccagccctttttatttttcttaaaatgcaaaccaaaatccttaccaaggccaacaagccactacatctcattgttagcgctcttcccctcagagactcctacactttaccacactggcctttctgctctttgagaaagagacatatggctcctgcatcatagatttgcttctacctggagagttttccctcagaaagcctcatgagtctcccctgtcattatttagtctctgctcgagtgtcacctcgtgaggaagtacagtgtaatagttataaaaacagacccagaagccagactccctaggtgtcaatttcaatgttaacatttagcatctgtaaggccttgacaaaattaacttctttgtgcctcagtttccccatatataaaatcagaatgattatagtatttacctcacaaatttgttgtgaggattaagtgagttaacatatataaagggcttaaaagagtataattcagtggcccaggacaaacacttgaaataaaggatttcctttatttcaaaaaaggcaaaaggcaataaaagaaaaaaaagaaggattaccttcaactaatttgcttcttagtaaatgactgagtcattgcattactcttcttttctaggacagagataaaagcactttgcaacatgaatctgatctcttaaaacctctgcagcagaggcccttatatctgcccactcccagttgcttttcctgatcctttgacacctttaacagacacttgcctgtcctcaaacattgtcatgtgtaaaatactacaacgtgtaaaaaggaaacattttgcatacagagatttctgcttgcacttgtctatcatttatttattcatttagtaatatatattgaatgtctgccatgtctgacatttatcatctgccaaaaataactaggtgtgtctattttctttaaggaggagcagaaattgatagcccgggtacatgctgattctggtagtaagtaatcagagatgaaaagtatcaggtaagaaaaactggaatacatgccagaatttgaaaagagacactttcatctcaaaatcaaaatcaaaacatactgctagttactgagtaggcatgggaagacaacggaagacctagaactgtcgcacatacagctttgctgagagctggatgagaaaatagaacattgtccttagaactatcatttttcctgctttatccccataccatagttttatttcgacaattccttattgtttgcatctcagctcaagactctctctaaagaaaatcattgttgcccttgctcacagacatttctaaatatccctggccaaaatgttctgacacataagtgtgtctcagaaccgacagtttcccagcagctgaaggaaatgaccttagttcccaaagaaagtctaacttgcagaaaagttactcgcttaatgaacatagggcagcattttctcccctccaatatttggattcattttgttgttgttgtttagcgacttggcattcatggagccagttttccctttgataataaatcaattgtagataaagaagaaagaatgaaaagatatctacatctcctggggctcccactcccaacttttgttattttcagcatggaaggtagaggcagaactgtagttagtgtctccaaggaccagtgcattaaagtaaccataacaaatcctacaggctgtttaagaggaaacccaagggccatgttcttcccatgatctttatgcacaattctcatcaatggtgatgggaatttccccacagacctagaaaggatgtgactcttaattacaccccttgataatcacactgattcaagtttaagttcaagaaaatcttaatcagtctttagcttcagatcaaaatattacgttggagcccactttcattttaggttatttacatcttcatgaatactcttttcaagaagtgttcccgttctcatgaagattttcttggctgtaccatatggcactccttcctccactccaatactccctggggtagttggaatgaaactattgccttacattgagtttatcttaattatttgaaggaacaaaaatattaaagctagatttccacatactagtggattgcttcagtgggtatggaaaagtggaggctaaaacagttgtctgtaaaactgaagtttatagtacttcaaaaggcttcacttatttgccattgattgttgaagaaagttcacattctttacacatgatagtcaagactctttgtggtttgattccaacacacctttcctgcctggttttctaaccctacccacaacaccttatgaagcttcaagtttactgaatgcttcactcacattctgcaagttgctgagattgaaattctgtgctttctctatcaccacaaactactatttttacaaaaccttctcaaattctccacctaaatcactcctttttttaatccctacaacgtttacctctatttattggttatttcataataactggtattatatagcttttgaatatcctagacatctctctccactagattgtaagtcctttccccaattacttatcactgtgcttgcctaaatagatggcgatagtagcctgatagttaccaccccaaaatccattattcattttccttcatagaaacagagtttaagctggacatatgaatatccagcgagagattacacattcccagtagctgtgtcagttacttacggtcatgtgccaaatctggggctcaatgtcctatgaacagaagctagtggaccactttcaattcttgattttaaaaactctgagtttgtatgtcttgaccttttgcacgttccgtggagtgagcacatgtgtgatggaaatccagctttgaccaggctgatgaagataaaacctgtggagtaaataagacggaagtaacctggcacagcaaatcactttgtgcaacagggccttgcaagcctgggcttcctaattttagccagttacacagatgagaataaacatctattttattttggtaggtttttggctttttcttttttttgactgcttgtttgcatgttttcttactacactacagtttggcctctattctgaataataaaaatgctaaattatcaaatgcaaaggtaacccacagaatggcagaagatatcttcaatttcatattctacaaaaattcatctctagaatgtataaaaaactcttagaaatcagtaaaataaacttgggcacccaaatagaaataattgacaaacaataggaaaaaattacatcacaaaaaagagaatccagaaagccaacacacatatccaaaggtacttgatctcagtagtaatctaatgcaagtgaaaagcacaatgtaatgccattacacactaccagaatggttaaactgaaaaagataagggcaagtgttgaaaaggatgaggagcaactggaacttaaacatactacaagcgggagagtgtattgtcataactgctctgaaaaactgtttggcagagtcttgtaaaataaaatacaacaaatgctatgacttagcagttccactttaggtacatctacagatacttatataaaaaatttttatagtatcactgttactataggtccaaactgggaacaacccaaatgtccatttacaataaaatggatatgtaagtatcaatatgtttatacaatggactactacagaactactacaggactactactacacaatgctctgtaccaggcattgtgataaaacctggggatacaaattataaaccaagtcaccacaaggtgcctatagactatagcctaacaaagacatttaccaaaaagtgcctgcaaagatatattacaagacagtggttacacgcaggaactttggagtcaggcagccctggcttctctgccacttacagtagtgggaccctgaacaagttcccctgagcctcaatttacttaatatattgagtaaattagtattatagtacttagtttatattattatatatactatatggtatgctatatattatatataatatacatatacttattatactatatgtatatatatagttattttgaagtattgatgagaatgtgttcagcacagtgtctggaatatagtaagtgctcaataaatcttaactattatgattactattaatattattttagcaggagcagcaggagaagtatggtggtgctcctaaggtagtgtcaattaaagggcaggaaataaagagactctaacagacagggcaataaagaacgaatgaaaaggaaagaaccagtgaatttattctatatggtcctaaaataaccatcgtgactacacgggaaaacaataagggatgggccccatcttctaccaaaaatgttaactcctacccagccttcaactcataaggtaccacttcctcaagtcatgtgtctaatttcataaacaacatgaatatcttagagctcagtattttaagccaggaaaagagataacaagagtggctatcaaacccctttctctgattctctgatattcctctgctttatagcagaggctacgaaggtacactcagaggttaagtaatttagaaccagagaatcattagaaaacagagtgagcctgagaaggatttttagcccaaaatggtaagctatcccttcagctgatccccttatctttgaaataacccccaaaaaaaaaaaattaaaatcacacttaatctactgcagcctgggtaaacaagaaaggcttatcagtggaaaagaaatttttagaaattcctggaaaagataaagaggatagaatggagttgctgggaaaaccaatcacagctgagacctattacccagattcactcaaaagaaggtatagagtcgctaaacaggggttttgcaacaaaagtcaggaactatccaaagttcagaggtggtagctagtggctgggaacagaagccagagcagacagcaatttcgggacattgcagagctgtagtagatctgtactggtctgcagacagacaataatttgcactgtaagtaactggggaactagtgcctgagacttctaggaatgccaatggtactttgggccctcagataacttgggctaccacaagtgatagacaaagaagacggatggagttgagcatttgaattaaagttttattcaacatgctttgaagtttcttaacatttggttgcaatttacgtttataattatatgaatatatttctttgacaggtcacaattttggcactctctaaagggcctaatttgacatgcaccataaatcttttttaaaaaatcacccagacacataattcaacttacagtatttccattttaggtggaactactcgtaagcagaaaggatttctagcatgacttttgtctttgtagctcaatagtattaccctggatttgggagagaaggtgaactcatttcaagaacggggaactaggtttttcagaacattgcagtagctgtagaaatgtgtgttgtaatggagacaagctacagggaaacatagaaagcttaatccggaatgctggaatggtgaatatggtaaatataactaagaaacaagagggaacttatcaaatttaaatgaaatttttgacatttgaataaaagatttcctgtgtggttattcaaagtaaaattattctgccccagaattccttttgcaaattaccctttaaaccaattgtgttttattgaggaaaaatgtgattcttttctctttttagccttttgttacagaaaatttcaaacatatacaaaagtggagagcttagtataatgaactgcacatagtaatcaccccctcaataatgaccacattagggccaatcctttttcaatttatcagctgttgactcaactacacttttcttctcgtagtaatggaagcgataatggaagtttaaaaataacgaagcagaacctggcaagggccgtaccaggtgttgtgcaaacaaaggactatgtgaacatttttaatgtgagaatagcttttagagattaagtccaaagaatgaaaagactttgagatgggtcttgaatgatggacactatttcaacaggcagagatgggcaaggagggtaaccgaagcataagattacaagttccatgaggccaggaacattttctatcttgcttactattgtgtttccaatatttaacagttccaatccttgcttgataaatatatgaattaattaatcaatgccatttattctgctttggttacctggcccttgccaggttctgctttgttatttttaaccttcccttatcgcttagactacaattttctctagcaatgggcttctttacattcatcttatatttcattactgtgacaagaaaagtgtagttgagtcaacagctgatacactgaattaaaaggcaagaaatatcacaagaattaatgctaagattttacaaaggaattcacagttctgttggatttagggtttaaaggatgtctctatggagctaatcattgatataagaatttattttgtgatagtcaatggtaccaattagtagttgaaaaggcagataaatcacataattctaagagaaaaatcagtgacaaagattttttttctttttgttttttgagtaaaataaatggttccatgtatatgggcatctaataggtctaagggaaccatactatgaatttgacttgaattttaaaagtagatgtaaataaatagcttgactattctacctaaaattgaccaaataccaaaactatatttaactttaattcgctagaatccctatagtgcacatttcaagaggtgtctctcttttgttgttggcacaattcaacttaattatgtgattttccaccccctgttttatgtatttgttttatttttacctttcttgcctttaactggatttattgactagtttttacctccatatacataggaaatgcttggagaaaaatcaatgtgttttatgtatacaatccaccaaatttaaactcttcaattaataagccacatatgagtgcagccaaaaagaagattaaggctctgaaatcaggattttgaatcatcttaaaacataatatgaaactgaacacaatgtcttagtgttctttaccacttaatactactgatcactctcatcctttgggaagttcttatcttttagggcttcagtgatctactttgcagggtgttctcctgacctttctgaccctctcacaggccatctatttctgtggtttcatctgagttgtctatttagatgccactccacacacatacatttattcctctaactcaatacctactgtaaacattctgctggagagcatgctcaacatagcaaaaaacaaattctgtgtattttctaggagtcaccccctcatctgtaatcttttgatggtgagaaccagtgttgaattatagttgctttttcttatcccctaaattatccctggccttcttaataaatcagtctccaaatatcacagatttcctctagcacaatgtcccgtgcatctgtctctttttacactatctttattcttgtccaggccctcattacctgctgcctgggctattgcaatgaactctgatctgatcttcaacccttttttcccactcattcaacatactagcaatgaaattttcatagaagtgaaactacgatcatattttttcttcaaaaaactccaaggtgttctctttccttcttaaattcagattcctcactttgacattcactaatctcccttctgaatccatcagtctccctcctcctgtcatttatttcctttatacaggctaaatcttacccctcttgctgttctctagaaagaccttttctttttccaccttgccatgattcaaaatcctgatttgactcaggtatatataattcaagaaaccttctagacaggcttcctcagagtctatgtacaggtatggacaaactgctgtcaaacatttgagaatttccatgttatattaattggctgtgttggaagacaaaggcagttcttggtgcatctcaaatgttgaagcattttgtcacagctcagagtctaaagcctcttcccaaagcatcttgtggttttcagagccttaaacttctttttggctgcactcatatgtgacttgttaattgaagagtttaaatttggtggattatatatataaaacacattgatttttctccaagcatttcctatgtatatgctatgtcaaatttcttcccaggttgggcagaaaaatctctggacttccaaaaactttgtctacttaaaaattccaataatatatcagatggaaaacttttactcccctatcactggaaaggctgtggcccaaaagatttgaagtgaatgggtggggtgggagtagtctgctctttttatccctctccccttctctcaccttggaggaacagcctattgctagaacatcgctttcctcttcctttttgacaccctgggtgttaaggagaggagggaataaaagagctggtagaaaatatattatgtaactggtatccaatatgtttccatctgtttctagtggcgtctgccaatgtcgtgctctctacccacaagatgtgtatgtatttttcttgggatgacttagcactgttattacattactaagcaccccatcagcaaggggctttctactctctattttttgccagtggccatgccttcactgtctctgtactagttatctattgctctataacaaattaccacaatgcaatggtttaaaacaggaaacatttattatcttgcagtttctgaggttcagaaatttaggcatggtgcaactggatcctctgatgcaggctctctcatcaggctcaaacaaggtgtcagccaggttctctcatgaggcttaattaagcaagtctcatctaaacacttggctaggaaaggatttgcttctaagctcatgtggttgtgggcaaaattcaagttcttggcacctattggactgaggaccagtttctagctgattgttggccagaggccacctgcaattccttgctgcaagagcctcccaacagggatgcttgcttcatcaaagcatgcaagccaagaaagcaatggagagagtttgctagcaaggtgcaaattatgatcttgataatgaaatactggaggtgacattccatcatctttactatattctgttggatagaagagagtaacaggttgtaaatacagggaagctgaggtcactaggggccatcttagactccaatctgtaacagtctcctttgggtaagcctggaccactcccatcctcctaccttattctctatcttccttcacttcgttcttcatgtggagcttcaaaagaattgaagttctcttctgcatcttgcaatggccacaaaaaacctgtctggggtgaggggtcattcccactttcccaggggcactataccactgtttcttctctctgttgtcacaatcaattccagcaagccttataccttctccaaatgacaagctgacgctagagtttatattcatgtactccttgcagattctagggaacacaagtaaaggcttgtcaaaaagtggcccaccctctccatctgagaggacctgtaagttctgcaagttaggaaacatccttcagagcatgtgatggcagtcttcatattttacagacacccctaagcttcatgaatgattctgttaaactggtctcatagagagtaggaggaaaaaccacagaacttcccaccaatctgatgctacttgactttaaccactatccctcatctcacagtcttcttgtacaagcacagaaagtgcaggaaggtttgagggctgtgaccagaggcaggttttgtcatctattataagtgctaaggggttcagggtaaagaggatataagttttccctcgcttaataggacatagtggtatgtaatactctttgaccccaggagtagagccctagttgccaattctgagaaaaatctccctaagcatcctcttatatgtgcaagtctaagaagaactctaggtgttaggctaccagagcctcctctacaccattaacctgtaatcctggatccttgtagccaatctaagtactggtcccatagtctcactttatctacttcctgccatatcttatatttagttgacattttttaaaaagtggtcactttgtccattgtcctagtgatatttaggttttgcactcttagttattgcctctctatcctgtgtcttttcattctcccaaaacaagacaatctcattcactccaaagcttcaattattcagtaactgtgaaatctgagcctcaagccccaatcacatcttcatttgtgcatccctatatttaaatgcacgttagtagagcatgcgtagaagagctgaggttccttagaaatgctaagtcatttctcaccttgtagaaaagaatgaaaaactatagactctttgactgttacaattaaaaggaaactctgagattgtcagccctcttcatttatcagattaggatcctaaaggaaaagttgtttaggagaagttcaaattagtttgctttactcaaagtacactgctttttctactgtataatacagttgtttggaaaaaaatattaagatcataccgtatttaccaaaattgcatatattacaggtattatacaattaaaaccacatactatatatatggtgggattttaactgagagttgctacattgttaaaaaaaaaaaaaaaaaaacttgtttggaagtctgtcctaagcttgcatattataaatgaattgtgcttctttgttttatgagagttgaaatcagacctcttaaacaatgcttacagaaagtactgcttctcttgctacaactggtagtgacccatgttgggggtgacagtacaattgagtctaccagaatgtgagaaaaggagtttttatattgcatctaccaaaaaggaaactccattttagttagaaagaagcttgcattaattcaacatttggatgaggtccaaagtcagttgcagtaaatcttgataactactgcttgtttcaagctagagccaagccgtttgtttattttaaacgcttgctcgatgggttactcccctgggaaaatgaccttgttttcatctcaggcccaagggaagcttcttatgctgtggaatcttattccagaatgtgtctggaatgaagaaagttgcagcctatactcagctagcatgatcatctcattcacttcatcgacaaagcttttgactttctaaaataaaagtaggaagacttggaaattttaacgcttcccttcatcctccaacaccctcatccccatcatccaaaatcacagctgagaactgctcagtgctacctaagttacttagttctcttttacttttggtgcccaaaggtgatagaagtacccaacccccatacagtcagaggaaacccagatgattctacggatgctctgtgggtatgaagcaacttgacaaataggccaactgcaaataacatgggcatctggaaggagcagaaagcaggtttgggttgacatgtaaatgtggagcctgtggtcactctagagtaacacccctttccttctttatctcccaccccaaacacacagttaggaaggcatctgcaatgcagacattggttaggtaccaggcctctcctgtacacacttctaacttgtaaatattcctcaaggtgatagtaccttttgatatctcaatcattaacttgttaatttgatgattgtttttcttttattattatactttaagttctagggtacatgtgcacaatgtgcaggtttgttatacaggtatacatgtgctgtcttggtttgccacacccattaactcatcatttacattaggtatttctaatgctatccctcccccatttccccaccaactgacaggccccagtgtgtgatgttcccctccttgtgtccaagtgttctcattgttcaattcccacctgtgagtgagaacatgtggggtttggttttctgtccttgtgatagtttgttgagaatgatggtttctagcttcatccatgtccctgcaaaggacatgaactcaacttttttatggctgcatagtattccatggtgtatatgtaccacatttttttaatccagtctatcaatgatggacatttgggttggttccaagtcttgctattgtgaatagtgccacaataaacatacatgtgcatgtgtctttatagcagcatgatttataatcctttgggtatatacccagtaatgggatggctgggtcaaatggtatttctagttctagatccttgaggaattgccacactgtcttgcacaatggttgcactaatttacactcccatcaacagtgtaaaaacattcccatttctccacatcctctccagcatatgttctttcctgactttctaatgattgccattctaacaggcatgagatggtatcttactgtggttttgatttgcatttctctgatgaccagtgatgatgagcatgttttcatgtgtctgttggctgcataaatgtcttcttttgagaagtgtctgttcatatcctttgcccactttttgatgggattgtttggttttttcttgtaaatttgtttaagttctctgtagattctagatattagccctttgtcagagggatagattgcaaaatttttctcccattccgtaggttgcctgttcactctgatggtagtttcttttgccacacggaagctctttagtttaattagatcccatttgtcaattttggcttttgctgccattgcttttggtgttttagtcatgaagtccttgcccatgcttatgtcctgaatggtattctctaggttttcctctagggtttttatggttttaagtctaaagtctttaatccatcttgaattaatttttgtataaggtataaggaagggatccagtttcagctttctacatatggatagccagttttcccagcaccatttattaaatagggaatcctttccccatttcttgtttttgtcaggtttgtcaaagatcagatggttgtagatgtgtggtgttatttctgaagcctctgttctgttccattggtctatatatctgttttggtaccagtaccatgctcttttggttactgtagccttgtagtatagcttgaagtcaggtagtgtgatgcctccagcgttgttctttttgcttaggattgtcttggcaatgcaggcccttttttggttccatatgaactttagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagaggtccttcacatcccttgtatgttggattcctaggtactttattctctttgtaaccattgtgaatgggagtacactcatgatttggttctctgttgtctattattggtgtataggaatgcttgtgatttttgcacaatgattttgtatcctgagactttgctgaagttgcttatcagcttaaggagattttgggctgagactgtggggttttctaaatatacaattatgtcatctgcaaacagggacaatttgacttcctcttttcctcattgaaaacccttaatttctttctcttgcctgattgccctggccagaacttccaacactctgttgaataggagtggtgagagagggcatccttgtcttgtgccggttttcaaagggaatgattccagtttttgcccattcagtatgatattggctgtgggtttgtcataagtagctctttattattttgagatacgttccatcaaaacctagtttattgagagtttttagcatgaaaggctgttgaattttgtcaaaggcattttctgcacctattgagataatcatgtggtttttgtcattggttctgtttatgtgatggattacgtttattgatttgcgtatgttgaaccagccttgcatcccagggatgaagccaacttgatcatgatgagcaaactttttgatgtgctgctggattcggtttgccagtattttattgagtatttttgcattgatgttcatcagggatattggtctaaaattctcttttttgttgttgttgtgtctctgacaggctttggtatcaggatgatgctggcctcataaaaggagttagggaggattccctctttttctgttgattagaatagtttcagaaggaatggtaccagctcctctctgtacttctggtagaattcagctgtgaatccgttctgtcctgaactttttttggttggtaggctattaattattgctcaatttcagagcctgttattggtctatcagagattcagcttcttcctggtttagtcttgggagggcgtatgtgtgtctaggaacttatccatttcttctagattttctagtttatttgcatagaggtgtttatagtactatctgatggtagtttgtatttctgtagtgatatcccctttatcattttttattgcatcgatttgattcttctctcttttcttctttattagtcttgctggtggtctatcaattttgttcatctcttcaaaaaaccagctcctggattcattgattttttgaagggttttttgtgtctctgtctccttcaggtttgctctgatctcagttatttcttgacttctgctaccttttgaatttgtttgctcttgcttctctagttcttttaattgtgatgttagggtgtcgattttagatttttcctgctttctcttgtgggcatttagtgctacaaatttccctctacacactgctttaaatgtgtcccagagattctgttacattgtgactttgttctcattggtttcaaagaacatctttacttctgccttcgtttccttatttatccagtagtcattcaggagcaggttgttcagtttccatgtagttgtgccattcttagtgagtttcctaatcctgagttccaatttgattgcactgtggtctgagagacagtttgttgtgatttctgttcttttacatttgctgaggagtgctttacttccaattatgtggtcaattttagaataagtgcgatgtggtgctgagaaaaatttacattctattgatctggggtggagaattctgtagatatctattacgtctacttgttgcagagctgagttcaagtcctggatatacttgttaaccttctgttgatctgtccaatattgacagtggagtgttacagtctcccattattattgtgtgggagtctaagtctctctggaggcctctaacgacttgctttatgaatctgggtgctcctgtattgggtgcatatatatttaggatagttagctcttcttgttgaattggtccctttaacattatgtaatggccttctttgtctcttttgatctgtgttggtttaaagtctgttttatcagagactaagattgcaaaccctgctttttttttgctttccatttgcttgggatattcctccatccctttattttgagcctatgtgtgtctctgcatgtgagatgggcctcctgaatacagcacactgatggatcttgactctttatccaatttgccagtctgtgtcttttaatgggggacatttagcccatttacatttaaggtaaacattgttatgtgtgaatttaatcctgtcattatgatgttagctggttgttcctttccatgtttagtgcttccttcaggagctcttgtaaggcaggcctggtggtgacaaaatctctcagcatttgcttgtctgtaaaggcttttatttctcatttacttatgaagcttagtttggctggatatgaaattctgggttgaaaattcttttctttaagaatgttgaatatcggcccccactctcttctggcttgtagggtttctgccaagagatccactgttagtctgatgggcttccctttgtgggtaacccgacctttctctctggctgcccttaacattttttccttcacttcaaccttggtgaatctgacaattatgtgtcttggggttgctcttctcaaggagtatctttgtggtgttctctg

SEQ ID NO: 9654 - DNA, 857 bp, Homo sapiens
catcgagtacacactattctgacggcagacctggttattgtgatgaagcgaggaaatattttagaatatgacactccagaaagcctcttggctcaggaaaatggagtatttgcttcttttgttcgcgcagacatgtgaaggagtgtcttaaaacaatacatgtatttaaaataatgcagtcataacctaattaatggatcatcagcttgacctctgtaaagtggcatcttaaaacttttacagatttttgcacaaaaagtggacatttatttttcctgtttttaaaacagtttttcaagatattattgcttaatatgttcattattgatgtttttatagtgatccagccactctagctttaagaatagctaggttgtattaaaacatgtaagctactttaagtgataaatcaatagctaaagttttctcctaactttaagtctggtaaatatctctcaggaatggaagtgtcaatgagtagtcagtattactatactcttgtttgtaagaatatattttccttattgttggagtctccagaggttattggaaggaataaaaaaggacatgttttctaacgaaactctcaaattcattatctacttcatgagaatttatttgtattcattaacattagtaatacctatttttcttaagagccttcttttttcccttttgtttcttgtcaccaagaagttatcacacttatacttattctataaggccaaagccttatctagaaagatcatgaagagtttggatatttttaaaactatactcgaattttcattttttcctgtcctgtaaagagagaattcttaagatatcaggcataatgtatgtaccttttccagact

SEQ ID NO: 9655 - DNA, 53163 bp, Homo sapiens; identical to SEQ ID NO: 9653

SEQ ID NO: 9656 - DNA, 857 bp, Homo sapiens; identical to SEQ ID NO: 9654

SEQ ID NO: 9657 - DNA, 184 bp, Homo sapiens; identical to SEQ ID NO: 7572

SEQ ID NO: 9658 - DNA, 131 bp, Homo sapiens; identical to SEQ ID NO: 6213

SEQ ID NO: 9659 - DNA, 187 bp, Homo sapiens; identical to SEQ ID NO: 7592

SEQ ID NO: 9660 - DNA, 220 bp, Homo sapiens; identical to SEQ ID NO: 7595

SEQ ID NO: 9661 - DNA, 143 bp, Homo sapiens; identical to SEQ ID NO: 7597

SEQ ID NO: 9662 - DNA, 141 bp, Homo sapiens; identical to SEQ ID NO: 7393

SEQ ID NO: 9663 - DNA, 184 bp, Homo sapiens; identical to SEQ ID NO: 7604

SEQ ID NO: 9664 - DNA, 125 bp, Homo sapiens; identical to SEQ ID NO: 7605

SEQ ID NO: 9665 - DNA, 183 bp, Homo sapiens; identical to SEQ ID NO: 7394

SEQ ID NO: 9666 - DNA, 154 bp, Homo sapiens; identical to SEQ ID NO: 7620

SEQ ID NO: 9667 - DNA, 162 bp, Homo sapiens; identical to SEQ ID NO: 6214

SEQ ID NO: 9668 - DNA, 1301 bp, Homo sapiens
aaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaa

SEQ ID NO: 9669 - DNA, 2434 bp, Homo sapiens
gatcgcgccactgcactccagcctgggcaacagagtgagactccatctcaaaaaaaaaaagacacatcaaagactaacaaaccaaatccttacattagaagaagtagtgaaataaagatactaaagatccagactcagtgcacttcaaactttttgaaatagctattctaacagatgtgaggtgacatctcattctggttttaatttgcatttctctgatgattattgaacttgggcttttgttcatgtactttttgctcatatgcatgtcttctttgagaaatgtctatatcaagtcctttgctaatattttatagtatttgttttcttgctgttggactgtttgagtttttatacatttgtgatattaatgcattatcagacgtatagtatagaaatgttttctgtcatgcagatgcttcttagagacaaggcctcactccattgcccctaggccaggcctggtgagtgacagcagccctggtgccccagcctgctagggcaatgtgtcacccagaggcttcaaggcccttctcaccatggtacccacctcctcgaagctgcctcccaaagccctctagctgctgctgcagccacaacaagtgccaccaccaggggccttccagctgccagtgcaggctttccagagccggggactggggaacctgcagtcatcacctcagcaattctggtggcagccaggccagccagggcagcgatgatgaccgtaatgaaaagtgggatgacagctccacactggtggatgagttgagaacaccaggcagaggcatgtacctggtctttgatggttcagtggacctgcactaccattgcagtgcaaagtgcaagagttgaagcttggaaaccttcacctagatttaggaagattcaggaaaagtctggatgtccacgcagaagcctgctgcacgagtggaaccctcatggagaatctctaccagggcagtgtggaggggaaatgtggggttggagcccccacacagagtcccactggagcacttcctagtggagctatgagaagagaaccactgtcctcctgacatcataatggtagatccactggcagcttgcactctcagcctgaaaaagctacaagtactcaaggccagcccttgagagcatctacagatgctaaaccctggaaagccacaagtgtggtgctgcccaaggctttgggagcccaccccttgtaccagcacgcccttgatgtgggataggaggtcaaaggaagttattttggagctttaagatttaatgactgctctgcttggttttggacttgtgtaggcttgtagcccctttcttttggccaatttcttccttttagaatgggaatgttgatccaatgcctatacccccattgtatcttggaagtaacaaacttgtttcttattttacagggtcataggcagaagggactagccttgtctcagataagactttggactgtggacttttgagttaatgctggaatgagttaaatatttgcaggactgttgagaaggcatggtagtttgtttgtttgtttgtttgtttgtttgtttgtttgtttgtttgttttttgagacagagtctccctctgtcaccaggctggagtgcagtggtgcgatcgcagctcactgcaatctctgcctcctgggttcagatgattcccctgcctcagcctccccagtagctgggactacaggcctccatcaccatgcctggctaattttttgtatttttgtagagatgaggtttcaccttgttggccaggatggtctcgatctcctgaccttctgatctgcctgcctcggccacccaaagtgctgggattacaggcgtgaaccactgcacgcagccggtagtattttgaaatatgagaaggacatgagatttgggagagaccagaggtggaacaatatggtttgaatctgtgtccccgcccaaatctcatgttgaattggaatccccagtgttggaggtaggacctggtggaaagtgattggatcatggggcggtttctcattaatggtttagcactatccccttagcgctgttcttgtgagagagtttgcatgacatctggttgtttaaaagtgtgtggcacctccccccacacttcctcctgctccagccacgtaagacatgcctgtggccgggcgcggtggctcacgcctgtaatcccagcactttgggaggctgaggtgggcggatcacgaggtcaggagatcgagaccatcgtggctaacacggtgaaaccccgtctctactaaaaatacaaaaaattagccaggcacggtggcgggcgcctgtagtcccagctactcgggaggctgaggcaggagaatggcgtgaacctgggaggcggagcttgcggtgagccgagatcgcgccactgcacttccgcctgggcgaaagagcgagactccatctc

SEQ ID NO: 9670 - DNA, 100 bp, Homo sapiens; identical to SEQ ID NO: 6215

SEQ ID NO: 9671 - DNA, 129 bp, Homo sapiens; identical to SEQ ID NO: 7645

SEQ ID NO: 9672 - DNA, 193 bp, Homo sapiens; identical to SEQ ID NO: 7396

SEQ ID NO: 9673 - DNA, 140 bp, Homo sapiens; identical to SEQ ID NO: 6216

SEQ ID NO: 9674 - DNA, 187 bp, Homo sapiens; identical to SEQ ID NO: 7657

SEQ ID NO: 9675 - DNA, 153 bp, Homo sapiens; identical to SEQ ID NO: 6795

SEQ ID NO: 9676 - DNA, 203 bp, Homo sapiens; identical to SEQ ID NO: 7398

SEQ ID NO: 9677 - DNA, 158 bp, Homo sapiens; identical to SEQ ID NO: 7682

SEQ ID NO: 9678 - DNA, 193 bp, Homo sapiens; identical to SEQ ID NO: 7690

SEQ ID NO: 9679 - DNA, 195 bp, Homo sapiens; identical to SEQ ID NO: 7691

SEQ ID NO: 9680 - DNA, 183 bp, Homo sapiens; identical to SEQ ID NO: 7707

SEQ ID NO: 9681 - DNA, 136 bp, Homo sapiens; identical to SEQ ID NO: 6219

SEQ ID NO: 9682 - DNA, 202 bp, Homo sapiens; identical to SEQ ID NO: 7718

SEQ ID NO: 9683 - DNA, 150 bp, Homo sapiens; identical to SEQ ID NO: 7399

SEQ ID NO: 9684 - DNA, 142 bp, Homo sapiens; identical to SEQ ID NO: 7400

SEQ ID NO: 9685 - DNA, 123 bp, Homo sapiens; identical to SEQ ID NO: 6220

SEQ ID NO: 9686 - DNA, 142 bp, Homo sapiens; identical to SEQ ID NO: 7402

SEQ ID NO: 9687 - DNA, 268 bp, Homo sapiens; identical to SEQ ID NO: 7767

SEQ ID NO: 9688 - DNA, 906 bp, Homo sapiens; identical to SEQ ID NO: 7771

SEQ ID NO: 9689 - DNA, 368 bp, Homo sapiens; identical to SEQ ID NO: 6222

SEQ ID NO: 9690 - DNA, 526 bp, Homo sapiens
tttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatca

SEQ ID NO: 9691 - DNA, 6366 bp, Homo sapiens
actaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataat

SEQ ID NO: 9692 - DNA, 2925 bp, Homo sapiens; identical to SEQ ID NO: 6223

SEQ ID NO: 9693 - DNA, 4704 bp, Homo sapiens; identical to SEQ ID NO: 7404

SEQ ID NO: 9694 - DNA, 11202 bp, Homo sapiens
atgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggtgggtgcccccttgtcattcatttccagacttttcatgctttgtctaaacttgtgtctaagttgtaggtattgtcatccactgaagatcatatctcattattaaaagctaggagtctcaattatttctttgtactacatttcactatatgagccaagacctggagattatgcaacctcagtgttgcctttccttgtaaattatactgttgaagttcttttgtgtaaatagattgtattgatttttatctgagtgtatccgttattttcacagtacacacatctttaactatgccttgtcccttgagagtttacttgtgcattaagaaattaaggagggctggtcgcagtagcttatgcctatatgtaattccagcactttgggaggatggggcagaaggattgcttgagcccatgggttcgagaccagcctgggcaatatgatgaatccctgtctctacaaaaaatacaaaaattagccgggcatggtggtgcgtccctgtggtcccaactattaatattcgggaggctgaggtgggaggatcccttgagcccaggaagtagaggctgcagtaagccaagatcaagccactatacttcggcctgggggacagagcaagactctgtcaaaaaaaaaaaaaaaaaaagaaaagaaagaagaaaagaaatcaaagaggatgctattcctttatagaaaggcaattttaatggtgacctgttgtgtagagtgccacatcttacattagttcacaagataaccctctgctactgtcttttgggtgcaggcgggtggagcagctggtgttgtacatgaaagcagcacagctgcttgcggcttctctgcatcttgccaaagcccagatcaagtccgggaaactgagcccatccacagctgtgaaacaaggtatgggagaaggcagcgtgtaactccaggggtcagtccttaagttgctctttcccatcacactgtgagagagtgtctgatgagtactcactgttgtttttatttttcagtattcttaaagggaaaagatgctgggttgttagctttttgcagttcaattgatagaagtctgaagtgcattattctcaatcttttcatattgaaagagataacatgaaaaaatcctatttctggtcctttttttgaatgatcacatagtgacaccttccctatatatcagcaggaaagatacatataactgtgtctttatttctggaggaaaattaaaattagttcccatctcaattttttttcagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggtaaccctttctaaggtttaatattgtatagtactacttatctttaagtgtctttttaattgaatatctatatgacagctatccttttaaaagataatgtctcaagtcccaagtattgtggattgccttctactaaagaagtaattggatttaagcaactgttaatgtcatttactggatgtattttaagtaattacaaatccgtttaccacatttgctataagtttattacagctcttattaaacattgctggcattaggcatgatctaatcttttttttttctttttttttttttcttgagacggagttactctgtcgcccaggctggagtacagtggcacgatctcagctcactgcaacctctgcttcccagattcaagtgattctcctgcctcagcttcctgagtagctgggattacaggcacttgccaccatgcccagctaatttttgtatttttagtagagatggggttttgccatgttggccagggtggtttccaactcctggcctcaggtgttccaccctccttagcctcccaaagtgctgggattacagatgtgagccaccgtgcccagccgatctaatctttttatagtgtgcatctaaaagcattagcaggatctgtttctgcattttctgctgtttaagaaagttaggcttgataaaactcttaggaaaaacactgctttattaatcaatccacacaaatttatgtgctcaggtcccacttactgatattgtaggatagacacaaagtaaaaccttcttttcctattttctggttttaatattggaaataatttgttttctgcctctcggggaaaaattactctaaagtataaataaaaatagaggctgttgaaaaagtagttaagtgggggaaaattcattagttagccaatcatatgtttttctttttttttttttttttttttttgagatggagttttgttctgtcgtccaggctgacgtgcagcagcatgatcttggctcactgcaacctctgcttcccaggttcaagcgattctgctgcgttagcctcccatgtagctgggattacaggcacctgccaccacacccagctaatttttgtgtttttagtagagacaggattttaccatgttggccaggcttggtcttgaactcttgacctcaggtgatccacccacctcggcctcccaaagtgctgggattataggtgtgagccactgtgcccggcatgccaattgtatttctaacacattaacataatagatccccctttccattttctatttgtctactgtgaactgtgctgttatattacatccgtggccttattttgaaatttattaaaataaccataggaaaataactttggaatataaattcttgacaaaaatagtatatatcatattgctgtaaactattgagatgaataatatgcactgcatcactgtatgctgagttgagacctcatatgataaattatttttagaattttgcaccagaaaaatgtcctccatatggaattataatgctgtttttccttctcagaataaagagccctataacttataaattcctccgttcgtcctggctgcttagtgagcttagaggcattaacacttagttatttttttctttttccttgtcctggctctgatcttctgtatccattttatttgctttattgttagctgcttgaaattattttttttgaaggagagagaatagctaggtgcagtggcatgcacctgtagtcccagctactcaggaggctgagacaagaggattgcttgagctcaggagttcaagattagtctaggcaacagagcgagaccccatctatataagaatgcataaatacattttaaaaattaaaaacaaaaacaagatatagcatattaacaagtaaattcggatactggatttctgagagttctggtacttaatgatcaaagagaaaatcagaatgtcgatggggaaacccctgtgaataatgctaccatcccctctttctggagagccccttcccacatttttcctcacctgattcacttctgctgttgttgctttatgattcagcacaaacagcacctcctggaagcttcccctaatcatcttctccttccgtaatataggttagaggcatcccctatgtattccgtatcatccagtgcttcctcctgtaacaccgtgtgtgccttggcattagaattgcattttttgcaggactgtatctccctccagactgcaagctctccttcattgtaggcgcagtgcctggcactttgttaggtgctcaataagtatctttgaatgaatgaatgactacacccaaaaattatttggctagaaaaagaagccagtaaagccagcaagtgactattagcatcatttaattatattattgaaacaaaatctactttaatgaaatttcaggttacccttatatggaagtgtgtgtttaaaatcaatttataatgaagtcataaaagagccagtttagaagggttctagtatgaaatttatgaagcatacctctgaataccagaaggctgtgtttgaaagcagaccgactttttatgaagttgctcttatatattgctcatcccaaagaatctttgagttttatgtagttttgcagactgtatcactttaccaaaatgtgttaattttaggtggattccatttaaagcttcattgcccaaatggatttgtattttcttggaaaaattgagagaattgtgtttttgttgactggttccaggttcagtctgcagccctggatgagatgtttcagcagaccgaagatattgtttatcgctatcataaggcagcccttcttttggaaggcctaagtaggattctacaggaccctgcagatattgaaaatgtgcataaatgtaagttgacttacaaagtagtgtatttttttacttcattttagttgtctatcacaagcatagtacaaagagcttggagtttggaattctgccttggtttgaatcgtggctttccagccttgtgcaaatcacagcctttgtgtggcctcagcttctttttcataaaataggagtagggccaggcacagtgtctcacgcctgtaatcccagcactttgggaggccaaggtgggcggatcacctgagctcaggagtgcaagaccagcccggccaacatagcgaaaccccgtctttattaaaaatacaaaaattagctgtgcatcatggcgcatacctgtaagctccactgctcgggaggctgagacaggagaatcgcttgaacccaggaggtggaggttgcagtgagctgagattgtgccactgcactccagcctgggcgacaaagcaagactccattctacgtagttaggtaggtaggtagataggtaggtaggtaggtagatacatacatagatacatagatagatatatagataaatagatgcataactagatagatacatagatacagcagtgcctgccttgcagggttgttgtgaggattacaggtgatgcatgaaaagcactggtgactgcgtaattcatctttagatttctacacggtgttactttgttggcaagtgttcgtatatgtaggaggactttagttttattattaaatgtaactgttttaagcctcatgggcttagtgactaaagagtcctgtgaaacttctgtgtactgcagacttggtatagatagcagactggagattgatgggataccaggatgttattacttatcacatacaagcccaataatctggttttttaggcagaggtggtggactggttggagtgtatgtggtcctgctacattttgagtagccacaggaggatggcagttctaagagtatttgcagttatgagcaagctagttatgtagcaagctagctgatgtgcttacctaaattttaccactttgcagcactaagctagaagtcatatctaaactattaccaagcagaaagaagaaaacatattcagaactgttaactttggggcaaagatagaatagagatgacaatatagtgatttttttcattagttcttcatttttgttattttatttctagataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacattttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattacttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttttcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaagacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctgagtatttttaaatttcatatcgtgtttcatagagtggaaatgtaccagttcatacattcatgggttgacacctgtattcaagccataacctggaaaattgctgaccagctattcctgctctaagggtttgctttaactataccctccactggactatatatagagagagagcctatgctgtatatagttggtttcccacagtccctgtcccctccttccattgagagaagtaactagagcaacagttgttctccctcgctggagtggtgaataggagccgggaggaggggactgttagggtcgggctgcctcagtctccacagtaattaagaggaaattgagttggatacagcggacatgaggcctggaatgggtaccccaaacccatgcatcttaagtgtctgggtccccacgcccccttctgcctgccaggagtactctgtgcagccatcctgtaactgcttcagtccagagaaggatagcatccatccctccctccagctcgcctctctgctgaggctttctcctctccactcagcatttgcaacagcttctctcctggcacttgtctgggaatatcaagttaaaaattacaacacccaattttgataactttagttgagagaaacaacctctagtgaagactgataagtaacttattgcccgtagtcccatgttcctttgtctccaccaagaggaattaccagcccagcagttctgccctcactagagtcccgtccaggagcttgagaggagaggatttttagggctggattgcctcagtctgcacagtaataagttgagttagacacagtggacatgaggacctggactcagatatctgaagaatccttattatttttttgttggcttgttttgagacagagtcaccctgttgcccaggctggagtgcattggcgcaatcttggctcactgcaacctctgcctcccaggttcaagtgattcttcttcctcagcctcccaggtagctaggattacagacatgcgccaccacgctcagctatttttcgtatttttagtggagatggggtttcaccatgttggtcaggctggtcttgaacaccagcctcagcctccccaagtgctgggattacaggcatgagccaccgtgcccggccaaaatccttaatgtttttgttttttggtttttttttttgagacagtcttgctctgtcacccaggctggagtgcagtggcacaatcttggctcactgcaagctccgcctccggggttcatgccattctcccgcctcagcctcccgagtagctgggactacaggcgcctgccaccacgcccggctgattttttgtattttttagtagaggcagggtttcaccgtgttaggatggtctcgatctcctgacctcgtgatccgcccgcctcggcctcccaaagtgctgggattacaggcgtgagccaccgcgcccgggctatccttaatgttgatattagtggttagcacatgttttggaggaggacttcacactttttaaactatgctccctcgtattttctataagcagtcttaaattctttctggaataaagcaagattgatcagtatttctcaaggaggattatttggcaggcagtagctactgctcagagaacttggtattgttacatgcatcctggaagtatctgtgcctatttctagacggcctcagaccacttttttctgagtcctggacccttgaatctgcagccaagcaagctcttgggtccctcccaagtctcatgtttagtaaagccctgtgagaataattttattggtggaggagtcaagatgatacttccctcacctgcatcagaggaaaccacatcagaaacaatccacctagaaaaacactgcatacgggaaagctgacaacttgccctgagaaatcacagctttggtgcaagaggtgaagccgaactggtaaaagatcaaagtgaattcagagatcaaactgtactagggaaaggagcagaggctgagatcttgctgccagcgtgacctctcacagagtggcccagcagaggctgtgcagagatggccagagccaggacccagccctgtggagcccctgggcacatgtggtcccgagtgaagccgtgcctgttgctctgaacaggtgggatcaatctgtaggtttttccacttttcacagagtgtggctctctttaggtctgcactccctctctgcgcagggcggacctccctgggctctgcagcatgatctcctgtcccaagacagtcgtgctcttggacagttagcttctgtcattaggaagtgcccacatgagctcttgtttattggaaaccgtgttctatgcctcctttggggtttctgcaactcaatttggcaggtagcttagtggtccacttggtctcaaattccagctccaccatgtgcagttgtgtgttctttggcaagttcctcccctcctccgaatctgtcagtgggggaagagtgcatgtctcacagagttgaggtgagaaataagttaatgaatatgaaattctttgcccagcccctggcacgtggaagggctcagcaatcctgtatccgttgtagtggtcatcactctgtggctcttcactgcttttgttttgttttgggagggggtggagaacaatttgttctgtgtttgtgtggggcaaggcctgtcttcagggctctctccaaccacgtacgctctggctggagcttctgaaaggacacagttcttgcatagaagttgctttctccagcttgcccaccaggcagtctggcttcagacatctatgttgcccttttaagtcaatttggctgtttaagtggaatgtttgtgtcagtctgataattgttaattcatttgatcctcataccaacccttacttgcctccttttacagatggaaaaatcaaacttggacagtaatttccacaaggaaaagccccacagctggaaagcggtgggagcaggaggccacactgggtacaggagtacccatctccccacaggagccccacactgtctcacccttaggaagcccaaatgctcactccttgagtttctaatgcattctttctgatgtacaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgaccca

SEQ ID NO: 9695 - DNA, 98 bp, Homo sapiens
gtagagacgggatttcgccatgttggccaggctggtctcaaactcctgacctcaggtgatccacccgccttggcctcccaaagtgcttggattacagg

SEQ ID NO: 9696 - DNA, 5088 bp, Homo sapiens; identical to SEQ ID NO: 7228
  misc_feature (5)..(304): n equals a,t,g, or c
  misc_feature (3943)..(4892): n equals a,t,g, or c

SEQ ID NO: 9697 - DNA, 2283 bp, Homo sapiens
atctctttgcattattacagttgttgttatttttagttctatttatatgaaaaatgtactttttagcccacaaaaatagcatagcagcagcttatcaaaatgtcccagacaagtttacttcaacaaattagtaacaccttcatgcttcctgtggtggaagaaatgcagagtccacttcctcccagtgaacatctgagccagatttctgctccactcggtcccccttcccacctcttacagccatgaaataatgtgagagtatttgtttcccctgcaaagggaagagggtccagagacaaaagggaagttagtattcactggaagcctccctgtacaagcaacagtgttaggacttttatacacatttttacaattattacagcagttctcaattattgaaacagagggtaggcatttcccctttttcagaagggaaaagtgagaattaagttaattccaaagtcacacagctagtgagagaaaaagcctggacaggaactcagactgtatgactccaaaggctaagtgcattctatacacacaggccgccctcctggcagtgagagttcaggatctgttggagaaaacctcagaccatggttttcttgcagcttctgctggagaacattaggtgcctgttcccccgtggtgagtgttacaaagtgcagcaccacccaggggaagagtctgggccttggagttagacctgagtttgaatcctccttcagatatttactattgatgacattggcaatcaatgctgctgaatttctccagccctccatttattcatctattaaggggagagctacctacagggcggggaacttacaaggattagatgaggggatatgtgtaaaggcctaacacccagtaggtgctcactaaatgatgttccttattattatggtgattaccactgtactcttttcagatgaaagtgttcggtcacctggaacctgtgagtatgtggtttttgatctgtgactaaactgttcacccatttcccagtttctctgctctgtcaaatatcaacattttaccaggtttctctgttgttgccaaacctgtcatttttatttggtgtggcttcttgggaaacttccatggcccatttgatgggaatcaaacagtgaaaacaaggacagatgcagcagaggtggcatcaggaacaaatgggtcataagaacttaccttggcagcagccccagaatggtcaggaggaaaggcactttaaggtatcagaaggtagaaaggagaggttggatgatagaatggggaagggattcctcctcgtgttcacagaagtgaatcaatgggagacacaaggttaccacttaatattcctgctctcctaggcatgggtcaggtacatcttcagccatgggtaagtttgttcaacaaatgagtgatctttgggaggctgaggcgggcggatcacgaggtcaggagattgagaccatcctggctaacacgatgaaaccccgtctctactaaaaatacaaaaattagccgggtgtggtggcgggcgcctgtagtcccagctactcgggaggctggggcaggagaatgtcgtgaacctgggaggcagagcttgctgtaagcagagatcgtgccactgcactccagcctgggcgacagagcgagactgcatcccaaaaaaaaaaacaaaaaaacgaaaacaaaaacaaaaccaaatgagtgatgcattgacctttcgtaattcttggatgcaaaagtagaactcaagctacttaataacaatcatggtggcatgggcaccagcaagtcagggtggacaacagccatagttctggagcatggtcctcaagactaccttttgtatgcagagtattaacactttaactcttagatccttggaacataaggaagagaggctggaacaaaaaggggttggcatttggaggtggagaggtagtgtaaggcacaactgtttatcaactggtatctaagtatttcaggccagacacgtggctcacacctctaatcccagcactttgggaggctgagccaggaggattgcttgagtctaggagttcaagaccggtctgggcaacatggtgaaaccctgtctctacaaaaaatacaaaaattagccaggtgtggtggggcacgcctatggtcccagctactggggaggctgagatgggaggatccacctgagcccttgggggtcgaggctgtagcaagtcatgattgcaccactgcactccagctgggtgataaagtgagaccttgtctaaaaaaaaaaaaaaaaaaaaa

SEQ ID NO: 9698 - DNA, 184 bp, Homo sapiens; identical to SEQ ID NO: 7572

SEQ ID NO: 9699 - DNA, 183 bp, Homo sapiens; identical to SEQ ID NO: 7394

SEQ ID NO: 9700 - DNA, 193 bp, Homo sapiens; identical to SEQ ID NO: 7396

SEQ ID NO: 9701 - DNA, 61 bp, Homo sapiens; identical to SEQ ID NO: 6218

SEQ ID NO: 9702 - DNA, 937 bp, Homo sapiens
gcctaacacccagtaggtgctcactaaatgatgttccttattattatggtgattaccactgtactcttttcagatgaaagtgttcggtcacctggaacctgtgagtatgtggtttttgatctgtgactaaactgttcacccatttcccagtttctctgctgtgtcaaatatcaacattttaccaggtttctctgttgttgccaaacctgtcatttttatttggtgtggcttcttgggaaacttccatggcccatttgatgggaatcaaacagagtgaaaacaaggacagatgcagcagaggtggcatcaggaacaaatgggtcataagaacttaccttggcagcagccccagaatggtcaggaggaaaggcactttaaggtatcagaaggtagaaaggagaggttggatgatagaatggggaagggattcctccttgtgttcacagaagtgaatcaatgggagacacaaggttaccacttaatattcctgctctcctaggcatgggtcaggtacatcttcagccatgggtaagtttgttcaacaaatgagtgatctttgggaggctgaggcgggcggatcacgaggtcaggagattgagaccatcctggctaacacgatgaaaccccgtctctactaaaaatacaaaaattagccgggtgtggtggcgggcgcctgtagtcccagctactcgggaggctgaggcaggagaatggcgtgaacccgggaggcggagcttgcagtgagccgagattgcgccactgcactctagcctgggcgacagagtaagactccgtctcaaaaagagaaaaaagaaacacagaaatgtgaaaaaggcccaaagttagagagaaaaacagaccccaaaaagggttaagtgaacatcccactctaaggcaagaaagaaatcctgaaatctgagaaagaaaaaagcatttc

SEQ ID NO: 9703 - DNA, 279 bp, Homo sapiens; identical to SEQ ID NO: 8074

SEQ ID NO: 9704 - DNA, 228 bp, Homo sapiens; identical to SEQ ID NO: 7231

SEQ ID NO: 9705 - DNA, 441 bp, Homo sapiens
atagtttagtgtctagcttctggtccacttgtactggtgttgactatgtatcagcccagcttatgtggctacagggattttcgttgcacatctgaatgaagccaaaaacatacgcaaggttttaagagtatttgatgtcttattggcaatacgaggtggaccagccatacagttagtaacataaccagcattggcttctggcacttagttctgagttctttccgaagaacttatatatgcagaaactggacttagcactcacttaaagaagaaataactttgataagaaccaggtgggttgttctttctctttattggtttcatgttttcagatcttgctaactctccccagctgtgccctgcagtggagacctatttgagactctgttatgatatgcccaagataccacacatgccctaggctcttcccctagcgacaac

SEQ ID NO: 9706 - DNA, 370 bp, Homo sapiens
ttctttgaccagtcctttcactgaaaagactgtatttagatatttctctgagtgttctagattcatagacccaaatgacctctctgagcatcaagatacatgaagaagttacttcctgaggataataaatatgaaaagagaattatcaccctctgctttcagaaatcacttaaaaaggaagggagtgcttttcccatgaggttcctgagacagagtccttatgtcaccttgtattggcaaaaagatctggggcactgtgtttgacgatagcacttctttgttcccctcccgatatatttacagaatataatcctattttgcttgcactcatttccataatactgaaagtaaataaaccttatataacgtt

SEQ ID NO: 9707 - DNA, 268 bp, Homo sapiens; identical to SEQ ID NO: 7767

SEQ ID NO: 9708 - DNA, 279 bp, Homo sapiens
caccaaattattgctaatcctatcatcactctatgaagaccttaacctcttacaaaggatctccccagccacccccagtgccttcctggcttaattcactaacaattaagaaagcaggccatagaccaatgggttcctcactgctaaactctgcttttatgttaaccccaccgcattctctttggaacccaacagggaccccctcaactaaagcagaatgatgccccgtggcccaagttcaccattcttcaaagcagctttcccacagagccctggaac

SEQ ID NO: 9709 - DNA, 821 bp, Homo sapiens
atctctttgcattattacagctgctgttatttttagttctatttatatgaaaaatgtactttttagcccacaaaaatagcatagcagcagcttatcaaaatgtcccagacaagtttacttcaacaaattagtaacaccttcatgcttcctgtggtggaagaaatgcagagtccacttcctcccagtgaacatctgagccagatttctgctccactcggtcccccttcccacctcttacagccatgaaataatgtgagagtatttgtttcccctgcaaagggaagagggtccagagacaaaagggaagttagtattcactggaagcctccctgtacaagcaacagtgttaggacttttatacacatttttacaattattacagcagttctcaattattgaaacagagggtaggcatttcccctttttcagaagggaaaagtgagaattaagttaattccaaagtcacacagctagtgagagaaaaagcctggacaggaactcagactgtatgactccaaaggctaagtgcattctatacacacaggccgccctcctggcagtgagagttcaggatctgttggagaaaacctcagaccatggttttcttgcagcttctgctggagaacattaggtgcctgttcccccgtggtgagtgttacaaagtgcagcaccacccaggggaagagtctgggccttggagttagacctgagtttgaatcctccttcagatatttactattgatgacattggcaatcaatgctgctgaatttctccagccctccatttattcatctattaaggggagagctacctacagggc

SEQ ID NO: 9710 - DNA, 2845 bp, Homo sapiens; identical to SEQ ID NO: 6281

SEQ ID NO: 9711 - DNA, 2395 bp, Homo sapiens; identical to SEQ ID NO: 6282

SEQ ID NO: 9712 - DNA, 38771 bp, Homo sapiens; identical to SEQ ID NO: 6652
  misc_feature (7892)..(9416): n equals a,t,g, or c

SEQ ID NO: 9713 - DNA, 5775 bp, Homo sapiens; identical to SEQ ID NO: 6656

SEQ ID NO: 9714 - DNA, 738 bp, Homo sapiens; identical to SEQ ID NO: 6657

SEQ ID NO: 9715 - DNA, 1316 bp, Homo sapiens
cttggctggaagtcttccagctctatgaatttatacactgagtcttgtcttgtgtcctcttttcctagcaaacaatatggcatctaaaacccagttctactctgataattttttctttacaagatgctacagtatgatacaccatgcccacctggagagaggataaaggtgatggtggtaggacagaatttccatccgcaatctccgttttgagcaaagaagcatggaggatggaagtcattgctgggaccccggagtagagtggtggtgggggaacagggggaacatcagactgccgaggtatgagtttgggttctcatcttcttcccaggaggcttttgaaaccccaggatgatgcctcctagaggccttgctgtcaaattcaataggcaataacatgaaggatttactcagccaggctcatgagaccagctctgaggaagctgtgcttttcttgtactgatcggtgatgtgcatcaccctaagggatagtaaacagatgaaacccagaaagtccagtcaaaagagcaccctctgggaatgaagatctagtgaagactggggagacagatgaggaaagagtcctgaacaggagccactcattccagctttgtctccatagcctgcccgcccacgatggatgaagtgcgtggaggagacaggcacgttcttcgagcccacgctggcggctttgtttgttcgtgaggcctttggcccgagcacccgaagtgctgtatgtgagagctcttcccagcccacatccctccaccccttcctacccaaagcagccttccctcttctattaactttgactttctcagtggtgtgtgtgattggggaattgggcagtcagagaagggccactgagagagggaacccaaaggcctgctccatccctggtgtggaaacagttcagcttcaggccacaaattctccatgacatgctctcacttggacaagtcacccaactttcctggtcttgtgtttcttcaaccatcaaatgagaaaatcgagccaggctcggtggctcacacctgtaatcccagcactttgggaggctgaggtgggcggatcacctgaggtcaggagttcaagaccagcctgaccaacatggagaaaccccatctctactaaaaatacaaaattagctgggcgtggtggtgcatgcctgtaatcccagctactcgggaggccgaggcaggcgaatcgcttgaacctgggcggcagaggttgcagtgagccgagatcacgccattgtactctagcctgggtgacaagagtgaaactccatctccaaaaaaaaaaaaggaaaattg

SEQ ID NO: 9716 - DNA, 2839 bp, Homo sapiens
ttcctttctccacagatcctttagttgctttagttgagctgctcctctagcagcagctccagcccaggcagctccttggggccaagcccttttccaagggtcagaagctgtgggcagggccaggctgaggcctctcctgatcctgtccccctgtccctggacctcactcccacaggccatgaaattattcactgcgatccgggatgccctcatcactcgcctcagaaaccttccctggatgaatgaggagacccagaacatggcccaggacaaggtcaggccaggcgtcctggctggtgtgggagcctgtgcagggaatggagtattggaacaagcgagatggggattggaagcaaatgccaaaggcccccccaggcacatgctaagtagggaagccactgggctgtatactcacactggcaacaatgtgagaggctgggacagggcaacgagtgggagaaatttcctctggtagactcggagagtattcctagcctcttctgtgtctctctccaggttgctcaactgcaggtggagatgggggcttcagaatgggccctgaagccagagctggcccgacaagaatacaacgatgtgggtccctgtgttttccagctccttttcagtccttgacttctcgtcacttctctgaccctcctaagtctttgttggacaatcagttttccctgggtgacttagctctgtccttactctggtgctggctggggttgatggggaaatatccacactgtacgtcttgctggcagaagaacagaatcttttcaggtcccaacgcatgtgccaacacacatgcatgcatcctgtgacttgtctgggcgtgttcatctgtgtgctgatatgtgtaaagcctgggtgtgctgtgtagtgatgccattgggctgctctctcctaatccctggatgcctgcctgtcagggcttgcctgtttggggtcaaatggtcccattggtgtttgtcagcgtgcatctatagaagtctctgtgtgcccaagtcacctcctgcctcttccccagatacagcttggatcgagcttcctgcagtctgtcctgagctgtgtccggtccctccgagctagaattgtccagagcttcttgcagcctcacccccaacacaggtatgacagcaggggagacacaggcactccatcccagagagacccatccatgattcacaggaaaggaagccagggctcagggcaggcagcatgaacagtaatggtagttgggagggactgtgtaggtctcagggtggcagggcaatacgtggtgggggctggagttcacatgtcctcttcccacaggtggaaggtgtccccttgggacgtcaatgcttactattcggtatctgaccatgtggtagtctttccagctggactcctccaacccccattcttccaccctggctatcccaggtatgggtcactctgtaagggtaggtagggagtttcccaagaggggccgacaggtgttatgatggatgggacttacggttggagaattggggtcacaaatgctgagagattctgggggtcaaataagcccttgtctccctagagccgtgaactttggcgctgctggcagcatcatggcccacgagctgttgcacatcttctaccagctctgtgggtaacaggggccactgggaggtgggataatagggaacctaagggaagaccacaagggaggcctggaggggaaagggaggttatttgagggtttgaggtggggcagtcctgggaactttgccatgctcctgggagctgattcagtctgtggtaccacccacatcctcacctaggcagcaccaaccctatgttctcttgctgtatgttctcttgtcccattttcaacagtactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggtatgcaagtgtcaagggccacagtttatgtgtactggcagactagaaaacatgtcctcaagttttccttccaccattcctgacacaagtacagttgcatggctttctgcccttcgcatccccactgaatagacggcaacttggggatccccctcctaccccagagatcctccattttaggacatctataggtcttctgggaagtactctttcttctggctcagatcaacttagtcagtgcagaaccagtgaggcaagggccatgggttttgggtactgtgtggagggactttcaaatggccacaggtctagagcctgatggcccttctctacccacccctacccaggcatacagcaagaggctgttacggcaccatggggagactgtcctgcccagcctggacctcagcccccagcagatcttctttcgaagctatgcccaggtaggcagcggccacctcccgccacagcttgctttatgtcagttgaacgccttattactgaagctcatggaagtcccctcttcagacactccgtcaaataccccaaaccctcttctgcagatgtcctcactgttatcttttctcttccctccctaccccttggaatcacccctcagatgactacaggttcttctacctaattcagcacccccacaactcaaaaggtagaaaaaactctattcccaagttcctccaggagaggaggagaccaacttttttttcctctcatacccccaaaatacagatgccttaaaaatgagcctgtggttgggcacagtggctcacacctgtaat

SEQ ID NO: 9717 - DNA, 5850 bp, Homo sapiens
aggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattggtaagagcacagcttggatgtgggctttcacgccggcagctgaggcagggcagggacctattcctggttccccaacctggcctcttctccccaggcaagtccatacaatttgtggggttcagaaaagagggtggtgttgtttagcttactaccaggtgctgaggctgctgtttgcccacctaacctggctctccctgatgcgggaacttccatggcctggcactcaacagctgccctcaggcacggagttggtttcttctctgtgttgtttggaaagcaggtaaaaggctttgatgttcctgccaaaggcttggaattacttgggtttagatctttggtggccaatcttggttacagtttgctgaagggaggtctccctacatttgctatgtagatgggggctccagtcagcattgtcagctggctctgcctttggggctccaggatgccagcttacttccctttcttcactctgcctctcaggccccacatcttagctgaggccgactctggtagccaaagtaccagagcagggctgagtcattttgtaggagggagcaccaaagactgagtggaaaagtcaggaaagttggcccacgttacccaggcaactgtgaacctctcaaccaacttcctcatcctctttgacttctcttaggttttcattttggccttcaggctgctagcttaacgattatcaggtctgaggaagccttagcttttgttccattgttggtgttatggccaccactgggggaaagcagaaccaaactcattgtggtggtgtttgcggggctagtgtttgaggccaagtggccattgcctgttttttttccaaagggttcaatgtggagacagtggagtataagaacatcagctttacagtgtgggatgtgggtggccaggacaagattcgacccctctggagacactacttccagaacacccaaggtatgctcaggcctagcgtgggttggttgggtatgagcagagagtgtggctgtctttgttaatgggtggccaactgttaccctgctgcagctcctgggggcagaagaaagggaggaaagggagcaaatatttggagggtgtcaggcaggtgtggtcttttggttggggggagggggttacctgtcatcttagtgcagcccatgctctgccttcctagggttgatatttgtggtcgacagcaatgatcgggagcgagtaaatgaggcccgggaagagctgatgagaatgctggcggaggacgagctccgggatgctgtactccttgtctttgcaaacaaacaggtgagacttcttcccacccctgaatttgggagacagcaaactggctgtggaaattgttggctcttgggcctattatatggttaacccttttagtatgctctcaatgttagaagcgtgggaaactgagcacttggcttctttatgcccctcttcttgtgccccaccccaagctttatttagcaacatttcagtcctcaggaattgtctcaaatctttctttcatcttgcctgttatctactttaggagaattggcctcactcctgctgtcagacagacctgattctttggtcagtctgaatcacgtctcttgcttccccaccatcctcgtatttggtttccaattcttcagtacagtgacctctagtgctttggatcttgagttctaggtgactaaatccaaagtagctccttaggatcttgttctgggtttcctaaaataaaggaggaggggaaggtgctggtacacatttctttggtagatgggtgttctagaagcctttaaaaaatcctgaggcttctttttatgtgtctcccacgtgctccaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttcaggcgtgtggtttttcattgtcaggatgccaagcctcatccagagatcccacaaatgtcttgaggaatagaccttttccataaagcctccatcctcccatcgcactcccaccactattctgttcctcccctgctaccagtgtctggctccaggcaaagaaagggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagta

SEQ ID NO: 9718 - DNA, 5852 bp, Homo sapiens
aggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattggtaagagcacagcttggatgtgggctttcacgccggcagctgaggcagggcagggacctattcctggttccccaacctggcctcttctccccaggcaagtccatacaatttgtggggttcagaaaagagggcagtgttgtttagcttactaccaggtgctgaggctgctgtttgcccacctaacctggctctccctgatgcgggaacttccatggcctggcactcaacagctgccctcaggcacggagttggtttcttctctgtgttgtttggaaagcaggtaaaaggctttgatgttcctgccaaaggcttggaattacttgggtttagatctttggtggccaatcttggttacagtttgctgaagggaggtctccctacatttgctatgtagatgggggctccagtcagcattgtcagctggctctgcctttggggctccaggatgccagcttacttccctttcttcactctgcctctcaggccccacatcttagctgaggccgactctggtagccaaagtaccagagcagggctgagtcattttgtaggagggagcaccaaagactgagtggaaaagtcaggaaagttggcccacgttacccaggcaactgtgaacctctcaaccaacttcctcatcctctttgacttctcttaggttttcattttggccttcaggctgctaggttaacgattatcaggtctgaggaagccttagcttttgttccattgttggtgttatggccaccactgggggaaagcagaaccaaactcattgtggtggtgtttgcggggctagtgtttgaggccaagtggccattgcctgttttttttccaaagggttcaatgtggagacagtggagtataagaacatcagctttacagtgtgggatgtgggtggccaggacaagattcgacccctctggagacactacttccagaacacccaaggtatgctcaggcctagcgtgggttggttgggtatgagcagagagtgtggctgtctttgttaatgggtggccaactgttaccctgctgcagctcctgggggcagaagaaagggaggaaagggagcaaatatttggagggtgtcaggcaggtgtggtcttttggttggggggagggggttacctgtcatcttagtgcagcccatgctctgccttcctagggttgatatttgtggtcgacagcaatgatcgggagcgagtaaatgaggcccgggaagagctgatgagaatgctggcggaggacgagctccgggatgctgtactccttgtctttgcaaacaaacaggtgagacttcttcccacccctgaatttgggagacagcaaactggctgtggaaattgttggctcttgggcctattatatggttaacccttttagtatgctctcaatgttagaagcgtgggaaactgagcacttggcttctttatgcccctcttcttgtgccccaccccaagctttatttagcaacatttccgtcctcaggaattgtctcaaatctttctttcatcttgcctgttatctactttaggagaattggcctcactcctgctgtcagacagacctgattctttggtcagtctgaatcacgtctcttgcttccccaccatcctcgtatttggtttccaattcttcagtacagtgacctctagtgctttggatcttgagttctaggtgactaaatccaaagtagctccttaggatcttgttctgggtttcctaaaataaaggaggaggggaaggtgctggtacacatttctttggtagatgggtgttctagaagcctttaaaaaatcctgaggcttctttttatgtgtctcccacgtgctccaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttcaggcgtgtggtttttcattgtcaggatgccaagcctcatccagagatcccacaaatgtcttgaggaatagaccttttccataaagcctccatcctcccatcgcactcccaccactattctgttcctcccctgctaccagtgtctggctccaggcaaagaaagggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagta

SEQ ID NO: 9719 - DNA, 171 bp, Homo sapiens
cccaagtgttttctttcttcttcttctttttttttttttttttttttgagacggaatttggtcttgttgcccaggctggagggcaatggcacgatatcggctcaccacagcctctcctcctgggctcccgggttcaagcaattctcctgcttcagcctcctgaggagctgg

SEQ ID NO: 9720 - DNA, 409 bp, Homo sapiens
aggctgttctcaaactcctgacctcaggtgatccacccgcctgggcctcccaaagtgctgggattacaggcgtgagccactgcgctcggcctcagcaggtatttgttatgtgcctaccatatgccaggcatagcatccagtctgagtgagctttcagtaaagtcagtagagaccctggggattagttcagtttttgaagtactgtgtgctaggcactattcttggtactggagacagagcagtgaacaaaacacataaggagctgatatcttaggcagaataaaacaatcagcaagaaataaatatataatgtatcagatggtgataaatgttgtgaagaaaagtaaagtgggataaatggggtagggagtggtgtgtgtctgtgtgtgtgtgttatacatgtggttgt

SEQ ID NO: 9721 - DNA, 171 bp, Homo sapiens; identical to SEQ ID NO: 9719

SEQ ID NO: 9722 - DNA, 409 bp, Homo sapiens; identical to SEQ ID NO: 9720

SEQ ID NO: 9723 - DNA, 4196 bp, Homo sapiens
caagagattggagcctatttagtggattttatgcagccaaagatgtttcttgttgttgttgttgttcttgcttttaactaatttgcctcccaggagacagttgaaatgtctagagacattttgattattatgcctggcaggacgccactagtggcatctagtggatggagggtaagggtgctgctaagcgtcctcccatacacaggacagcaccccccacaaagaattatccaaccccaaatgtcagtagtgctgaggctgagaaaccccactctgctctctaaccaaaattagacacagaaagtggagacattctaccaccctgacaacatcaatggcttttgcccatttaaaacaagaaagaggaatatgtatccaacccaaaacaacatcttaacattctttctaataggcttttgcaaaaatagttcatattttataactgtcttgcagcatggggtataagtgtaatcattgtaaaaatgaaacctaatcattgtaaaaatgaaacctaatcatggtaaaaatgaaaagagtgcctcaaaacatctgaagttcttagcagagggcagcctgtcttcagtgggcacttttggatggaggcaggactagggtatcagtaggagtgagaacaaaggtcagaaaaatgagtacacagcacatgtatactgattaatttctttcttttttccttcttttgatggagcaagactgtaacagaagcctgagagtgaggaagggctttgccaactattactgtagacacagtagtttactcaattttatgaactcttagtcctgggctggaattcacgcctctgctggaattgcacagacaaaacgtgcttgcgaggagtaaggtggcaacaaaagaaaaatgcaggcaaaaacacgcctcattttgaaaccggatctgagcatcctagagccagagcctctcccagccaacattgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggacaaaggaagagtcgattagaaacagaccatgtgatgacagaaacagagggaggtcagaggtgaaaaagagaagatgctgcagtgctgcctctgaagatgaaggaaggggccatgagccaagggatgcaggcaacccttagaggccaggaaaggcaagggaacggatgctttcctagagcctccagaaggagcacagcctggtcaacactgatttgagccccataagactgagctcagtcttctgacttccagaactgtaagagaatagattcgtgttgtttgcactttatggccatttgttacaggagcaacaggaaattaacataccatgtttgggccaggtgcagtggctcacaggtgagcctataacccccagcactttgggaggccaagatgggaggatcgcttgaggccaggagttcaagaacagcctggacaacatggcgaaactccatctctataaaaaatgcaaaaattagccaggcatggcggtgcatgcctgtagtcccagctcctccggagactaaggtgggaggatcgcttgagcccaggaggcaggggttgcagtgagccaagattgtaccactacactccagctggggcaacagaatgagaccctgtctcaaaataaaaacatatcatgtttgaagaaccaccaataggtatcttgctctgtgacttgtgatccttaagtcaacatatatatatatatatagtcacaggaagtcgatacatatatgggataatcaccaatctctaagatacatagcatgctcataaaatagccaagctctgtgctgagagacaaagacataaggctcattggtaacggtggtaatagcagctctcggtctgagcgatgtttggcatctgaagtcaccattagcattttcagagaagtccagctttttaccatataaccattcattctgtcttccaatgtgatccttaaggaaaaaaaaaattcccccatagtcgtgtgatgtttaaaatgtgtttattataccttgcctgtcatttttctggcttttagctaaaatgttttgaattgagtggtgatattcccgacttaactctgaaccctctctattcaggtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaa

SEQ ID NO: 9724 - DNA, 4200 bp, Homo sapiens
caagagattggagcctatttagtggattttatgcagccaaagatgtttcttgttgttgttgttgttcttgcttttaactaatttgcctcccaggagacagttgaaatgtctagagacattttgattattatgcctggcaggacgccactagtggcatctagtggatggagggtaagggtgctgctaagcgtcctcccatacacaggacagcaccccccacaaagaattatccaaccccaaatgtcagtagtgctgaggctgagaaaccccactctgctctctaaccaaaattagacacagaaagtggagacattctaccaccctgacaacatcaatggcttttgcccatttaaaacaagaaagaggaatatgtatccaacccaaaacaacatcttaacattctttctaataggcttttgcaaaaatagttcatattttataactgtcttgcagcatggggtataagtgtaatcattgtaaaaatgaaacctaatcattgtaaaaatgaaacctaatcatggtaaaaatgaaaagagtgcctcaaaacatctgaagttcttagcagagggcagcctgtcttcatgtgggcacttttggatgtgagtcatggactatgggtatcagtaggagtgagaacaaaggtcagaaaaatgagtacacagcacatgtatactgattaatttctttcttttttccttcttttgatggagcaagactgtaacagaagcctgagagtgaggaagggctttgccaactattactgtagacacagtagtttactcaattttatgaactcttagtcctgggctggaattcacgcctctgctggaattgcacagacaaaacgtgcttgcgaggagtaaggtggcaacaaaagaaaaatgcaggcaaaaacacgcctcattttgaaaccggatctgagcatcctagagccagagcctctcccagccaacattgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggacaaaggaagagtcgattagaaacagaccatgtgatgacagaaacagagggaggtcagaggtgaaaaagagaagatgctgcagtgctgcctctgaagatgaaggaaggggccatgagccaagggatgcaggcaacccttagaggccaggaaaggcaagggaacggatgctttcctagagcctccagaaggagcacagcctggtcaacactgatttgagccccataagactgagctcagtcttctgacttccagaactgtaagagaatagattcgtgttgtttgcactttatggccatttgttacaggagcaacaggaaattaacataccatgtttgggccaggtgcagtggctcacaggtgagcctataacccccagcactttgggaggccaagatgggaggatcgcttgaggccaggagttcaagaacagcctggacaacatggcgaaactccatctctataaaaaatgcaaaaattagccaggcatggcggtgcatgcctgtagtcccagctcctccggagactaaggtgggaggatcgcttgagcccaggaggcaggggttgcagtgagccaagattgtaccactacactccagctggggcaacagaatgagaccctgtctcaaaataaaaacatatcatgtttgaagaaccaccaataggtatcttgctctgtgacttgtgatccttaagtcaacatatatatatatatatagtcacaggaagtcgatacatatatgggataatcaccaatctctaagatacatagcatgctcataaaatagccaagctctgtgctgagagacaaagacataaggctcattggtaacggtggtaatagcagctctcggtctgagcgatgtttggcatctgaagtcaccattagcattttcagagaagtccagctttttaccatataaccattcattctgtcttccaatgtgatccttaaggaaaaaaaaaattcccccatagtcgtgtgatgtttaaaatgtgtttattataccttgcctgtcatttttctggcttttagctaaaatgttttgaattgagtggtgatattcccgacttaactctgaaccctctctattcaggtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaa

SEQ ID NO: 9725 - DNA, 200 bp, Homo sapiens
gtccgtcgtacatctctggttggtgagtgagtctatgaagacagaagtaccagttctcagcatgggccatggactcatcttgtccacctcatgatatgatctgagggtgtcataatcagctataaaggtaattgcatactcaaagatgagacggaccattctcagttgatgaccacattaagcatagtcatggccatctg

SEQ ID NO: 9726 - DNA, 200 bp, Homo sapiens; identical to SEQ ID NO: 9725

SEQ ID NO: 9727 - DNA, 1217 bp, Homo sapiens
ccagaaataaatggcctaaatggaggaggaaagacccaaagtcttcctctaatgtgttctgtctccaagcagtgaagagaatgctttggttttaaactagttaatcagaatgatatagccctccttcctggaatgaacctttctcactgccccccttctccaactgttggtatgtctcaatagttccttccccacatatgcaagaggctgccagaatcttagaaatagcagcctggtcttcagaaactctcccctagttcctacctttcctcctcctcccctgctctactctctcctcactgtctaagactattctgagttgtggatactggacactgtattttgaaccagttctttggctctcttctcagccacctgatcatttattaggcatatctctttggtggttcatcctactttctctccagatatcatctggattcctggtatatctttgtgggggtggggagcagccctaccctgtaactgtaccttgtccagctcctcaaatccaagtttctcagaacccagggcttgaaaggaaagattcaacactaaagctgtagctaataaacacacagggttggaagttacccagcctacttgtagacatagaaaccttggccagaaaagcaatgacttgtccaagtcactaagaatagtaaatgaaacagaactgaagtcccacagtgtctggttattgtttttaatgtaaatgtactactgtactatagcatacatacacaaaggcaaacaaatcagaaatatacagattgagtctctgaatgaagtttacattttggttctgaggatgaagctcggaattttttatcttgcccaaattcctatctaaggggtctggggagtatgccctagaaaccacaaattctcatcacatgggttttatttaaccttgtatatcatgacttattttccaatctgactttggcataacaaggaaaaaaatcaaaatgttttaccccaaaatatatttccttgccataccttgaaattgccctgcaaagtctctcgtgggaaaaatccacattatatggagaatctccttccccctttgttttccttcctctctttccagatctgggagataatcagctaagagccaggcacccttttaggtctgataagaaacattttacaacctgctcgctctctgaagtctgctttctgagagattcctctgcacaatacaacttggt

SEQ ID NO: 9728 - DNA, 1287 bp, Homo sapiens
gtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 9729 - DNA, 4158 bp, Homo sapiens
gtgcacgccgaatatctggagaaactaaagctgggcggttccccaaccaatggaaactccatggccccatcctcgccagatagcgatccctagtatgtaccgcttgcgcccgcacagacttctgtttgtctgccttgcttaaaatgcatcccgcctggagcacctctcgtaccatgtgcggtctcatgggcaggagggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggccaggggtgggcggggagtgtgtgtgtctgcctgtgcgccctgtggtgtttttggttcttttatatttcacacatattcgggggtgcgtgcccctttttgataccccccttgtggtttgtttggtagtggaggcctttaaagtctgaccagcttggttgtgtggcatcttttagtatttttttcccttgagttgttttctccttcacagcgttcgcccttgttgtcagggaggccttctgtggtgggagttggtttaaaaaatcagttttgaattcgtaaaaacattaggaaatcctacatcttgtgctctttctgcactcgacagtcgctctagcctctgaagtggtatctcatttgcccctttcagaaatttctttttctatttctatgtaggtcatttggttttcaaaaaattttcacaagtaatttttcactgctgactttaaatcgctatttcccatgtagattaaccttactgaatagatgctgctggggatctgctagccaaacgcatctgatcagaaaaactgtattcacagaatttgatttcccatactcaacttccaactcccattgccccttactggataccatagaagaaccatggttctctggatttaagtttgtttttgaaagaaagtggtttccattccatatttgaatgtagtgacattccgcttaacctccctgactcccagtaaccacaggaatggaatcttttgtggtgattacatcccaacagagttagctctagcgatgttcagctggtacagaattgtcaaactattaggattcctgaacaatctctcaatgatagagagtaattgttttgtctcacagtaccaccttttctgggtgccaaattaaaagctctcacgtttgcctcagtacttgcttgaagtcaggaatcccatctagaatagctaaatctctcttctggaccttccgctgttcccccagccatgtctgacattaggtagaaggaaaacctattttgtgaagagggtattcgaatgaaaagatcattcctaatttctagagcaacctagactatgtcatatctcttaaacattattgacaggtattggggtcccttaacttttttttttgagatggagtcttgttctatgggtcactgttacgcactttctattaagaaattttgggtttcgctatgtaaattctaggttcctcttctggatttcatctcccatgacagttgaggaaatgtctagtttttgaagagagtatgggtgggggctgggggaccgggcgcggtggctcacgcctgtaatcccagcactttggaaggccgaggcgggcagataacgaggttaggagatcaagatcagcctggccagcatggtgaaaccccgtctctactaaaaatacaaaaactagctgggcatcgtggtgtgcgcctgtaatcccagctactcgggaggctgaggtaggagaatcgcttgatcccgggaggcggaggttgcagcgagccgagatcgtgccactgcactccagcctgggcgaccgtctcaaaaaaaaaaaaaaaaaaaaaagactgattttccccctcgtccctgtcccccaatggacaagtgcctactttttcttattctaaaaaaaatttgaagacgacatgttggagtaaaggtaagtttggttgcttgatacagaatttgctctggatggttaacatattttctaagaaacctatgttctgttgatcaggtcacctttgaaagaagtaaccctgaaaggggtgaaaggtggccataaatatttttaagtcctgtagaaaattgataaaaattgaagtgtgtatgtgtaagagcttgtaaagaaacagcaacattagagggcccttgtgggatagatggtttaaagggctctgatgctggagctgctccttgtctcacttgcctttaagtggagttcaattgtaagaaaaagcatgtcctccctccatagttgttgactgggaaaagggagattagagcttacagcactaacagctggccagagttttatttttcagagttccttttgtggaagcatcagtcaaaacaaatattctcagcatcattcttgtattgcaatcatctttctgaatgactgttggcctattagaatatggactttttgaggactaggacccagactgaatcctcccccatatcctcagagcctagaacagtgcctgaaatttggagacatttgtctttgatccacagattagaaatgtctacaagtgtattcccgatttctgagcttcataatgtacctgggacaatctgttattccctcaggctctcatctggcctcacagtgaaactgcattcgataattcactgaaggcttttccaattcaaaatggttgatgagccatagtaggtgctcaataagtatttgttgattagaggaatggatgaaccaataaaaccctattaataagaatttttctttttaggtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 9730 - DNA, 322 bp, Homo sapiens
cagattttttttttttttgagatggagtcttgctctgtcacccaggctagagtgcagtggcacgatcttggctcactgcaagctccgcctcccgggttcacaccattctcctgcctcagcctcccaagtagctgggactacaggcgcccaccaccacgcccggctaattttttgtatttttagtagagacggggtttcacggtgttagccaggatggtctcaatctcctgacctcgtgatctgcccgtctcggcctcccaaagtgctgggattacaggcgtgagacaccgcgcccggccagcagatttttttttaagtttag

SEQ ID NO: 9731 - DNA, 322 bp, Homo sapiens; identical to SEQ ID NO: 9730

SEQ ID NO: 9732 - DNA, 126 bp, Homo sapiens
agctactcaggaagctgaggtggaaggatcgtttgagcccaggaggtcgaggctgcagtgagctgtgatcatgccactgcactccagcctggggtgacagagtaagaccctgtctcaaaaaaaaaa

SEQ ID NO: 9733 - DNA, 28514 bp, Homo sapiens
ccaccgctgggtccccagcattaagccctggagcatgagcccagtgaactttgaaattcaggaaggaattcacaggaaagctgcggcgaggcgggcagaaaaccacaggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacggtgagggccgggcgggtaggctggaggcggggcgcagggggcagaggctcgggggtcaacgggggtctgagcagggagaactggcgggggaggaaactgggggctacttgatggcgttcagcgggtgtggtggaaccagccctggaggattgagccttgaaatgaggtttgggagccttcgacagcgaagacgggcggaggagcgagggttaggagagtttccttcgggtggaggaagagtcaaggggtattgaccaagaaggcgtggcactgccccttcctgtggcaagaacggggtgaggagccgaattgaagaccagccttctcctggcggtggaaagttccatggccaaagctcagggagaggccaggcctgtgagatggtgggggttgggttgggtgacctggtggccgttttagactcggaagaagcccatctcacccctgcctctttggagattggacaagagcctcccctgaagtttttgtagttgagttgcagtaaagtaggtgcccgagaaggagggagcaagaaaggaaacaagctttggggaagaggaagctctgctaaggctcgagagagtattggcgttgagcagctggtgttggggtctttggattggcccttagaagtcggtggtgaataaggtgatttaaacttctacactcttaaggaagtgtggtctgaaaggtctctttgaacaagtgttgttataaccttaactgcttcagacaagcaccagcgtgttttgaaaagagctctcttgaaagcaagaattcattgattcagcaaaacttactgaggccctgctacgtgtcaggcactggcgctggttataacagttaactcagactagctgggttcctgcattcacagagctaatattccagtgggagaggcagagctagtgaaggtttaaaaagcacttgccatgagattaagttactgagaattaaatgaaccaggtgaagtacaccaacagggtgacgtaagatgttgggggcggctttagctcaggtggtcgggggacgtctccgtgaggagggtgacatctgagctctaacatgaagaatgaggcagtagccacacggagacctgggggaccagtgtccagttgcaggcaatagagtacaaaggccttgaagctggaacaagcttggttgggttcagggaaaagacagagccagcctggctggagcaggcgtgaaggaggggaggactggaggaggatgggaggtgggagaggttggctgcagccagatggcctagggctttatagacaggtgctggtgcttgaacccgggaggcggatgttgcagtgagccaagatcgcgccactgcattccagcttgggcaacaagagtgaaactcccatctcaaaaaaaaaaaaagaaggccgggtgatgtggctcatgcctgtaatcctagaactttgggaggccaaggcgggcagatcactggaggccaggagttcaacaccaccctaggcaacatgatgaaaccccgtctctaccaaaaatacaaaaattagctgggcatggtggtgcacacctgtagtcccggctactcgggaggctgaggcaggagaatcgcttgaagcccagaggcggaggctgtagtgagctgagatcaagccactgcacagcagcctgggcgacacagcaagactcagtctcaaaaaaaaaaaaaagagcaggctaggtgtgtaccaagtcatcacctgtggtaacttctggggactggttaatttctctgtgccctaggcaggagaaaaaagtgaattggtggggagaggctcagctgtaggtgactgggagtcaggaatgcagacgttgatcattcttgcaattcgaaccagaatttggcagctctgctggactttttcagtttaagtaattacgttaggatgtacctcccagttacctggcctcttgctacctctggtgcttactctgagctgggacatggcctcttgctacctctggtgcttactctgagctgggatgtgccatttaacctttgaaacagccgggtgcggtggtgaagttacttgccttgcccgaggtcactcggtagtagtaattgacaaagccaggtctcactgcagaggccttctctgttcagagtggcctacctgactgctgctgccgactggacctactgacctttcagaagtactagtgtctgactgggtgaactcatgccctcactcatcgtaagttctgtttgtttgaaagcttgaacagcttaatcggaggcagaaggcagttttgacttttttttcctcgctccttcctgattgcttctgttttctccggaagcgagtcatccactgggagtgtggtgttgctgaagctccatgcagtggctcaggtgctgctggatgagtgtggtggtgagggaggagtgaacagagaatgtgtgagggagggaggatgggggttggtcaaggaatttattctgtatgaaaacatgagggggcggagggccgaggtagatggtagggccagcagattgttggagttgaggttctgaagggaatgaaccagacagataggatgcagtgggtagtgagtgagatgcatgagagggaggttctgaagaggtggcagttactgagacaggtctaggtgtgaccctgagaggaagcgggggggcgagggtgggaggagatcaggtggaggtcttgggacctagaggtcagaggaccatctacctggatatagaaatctccaagaatgatcataagagcagcgggagaggtggcaggcccggagctaaagttgggaaggaagaagtagttgtctgggttggcagataacgtgccaggcggggtagtgaatgatttactctaataatggaagtctcccagctggggattttggggagggtggagggagaacagtccagaagcagctcccaggagcaaggagacctccccacttggaagggccccaggaggtgtgccctcaggggagattccaattaggtaagagggtggcaacaatgttcagaggagattgaggacatggaagatttgctcaagaccagtcctgagtaccagagggcccaggagttgggggaggggagatggggacaaagcaggccccaccgtgtgagagtgagggttaactcaggggtcggggcttcttgtgagaagcatcatgtggtctatgattgatgtgttggtgacgctctgagtagtgagggcaggtgggaagggacaggtggacgggccggacaaagagtgtcctgactccaacctctgcagacagaggtggggggaaagctgagcttatgccaggtgagaaagctcccctatctagcgttagggacagttaccgtctggagtggaaagcacgcagagattataaactgtccactcccaggaagcttcacacagcctttatgtgacttgtactttttccagaattgggattttttaaacgtaaaaatgtagtttttggctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgcgcgtgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggcttaaggtcttttgtttttgtttttgtttgtttttgtttttttgggtttttttttgagacggagtctctctcatcgcccagtctggagtgcagtagcgcgatctcagctcactgcaatctccacctcccgggttcacatcattctcctgcttcagcctcctgagtagctgggactacaggcgcccgccaccacgcccggctaattttttgtatttttagtagagacagggtctcaccaccgtgttagccaggatggttcaaggtcctttgttgattcttcttgggaatttccactggaggcaagcagggcaacacttatttgagaacctctcctgcacctttttttttttttttttttttttgagacagagtcttgctgtgtcactcagactggagtgcagtggcgccatcttggctcattgcagcctctgcctcctgggttcaagtgattctcctgcctcatccgcctgagtagctggggttacaggtgtgcaccaccacacccagctaatttttgtatttttagttgagatgggatttcttttctttttttttttttttttttgagacggagtgtctcgctctgtcgcccaggccggagtgcagtggcgcgttctcggctcactgcaagctccgcctcctgggttcacaccattctcctgcctcagcctcccgagtactgggactacaggcacctgccgccacgcccggctaattttttgtatttttagtagagacggggtttcaccgtgttagccaggatggtcttgatctcctgaccttgtgatctgcccgcctcggcctcccaaagtgctgggattacaggcgtgagccaccgcgcccggcctgagatgggatttcaacatgtgggccaggctggtctcgaactcccgacctcaggtgatctgcccacctcagcctctcaaagtgctgggattacaggctcgagccacgtggcccagccctctcctgcacttccaagggattttcgaaatgcatggacctctcaggttaattatagtgtctgtagaaccttaactgctgtaagctttccagcagactccacagacgtgttattagttgccaccctttctttactttcctcctcacccccatggatagtcgtgaccctggtggtcagagataagatgacagaagagctaaagtaaagctggtgttggcgatcagctgggaattctctaaaacagcttctcacattattcttatcctccatagaaggagtgcttgtcctacttgcaggcaaggcagtttggttccagggtagttcgaaatcttattcactgatatagtcagcaaatgtttattgagcacccaccaattgccaggcactgactcactcaaattagagcactgaacaaaatagaccccctcccccatccgtggcagacgtgtcataatgagaggaagacagtacaataaatgaacagatgaatgtatgtctggtgatgagtgtcagggttggtgtgcttagcactgaaaatgggggcttctgaggttcaaatggttgcagttcctaaagaaggttgagggccttgccttcaggtcaccgcgggagactggcccctttccactggaaacattgctttgcccagtcagtatttgagagctcagcctgcaatggagaaatcacacttctcctctttcaccctgctccccaccctgtttctcattttacccatccccagccatttgcagaatgcatgcagagcttctgtttgccatgtctggaggctacaggggaggctgaataaggggtgataagcctgtggctcatgtgaggcgggagagagcccagcaggagtcacactgaaatgactccattagccccaggaggccttggcccaccggccatgactaatgtggacattagagtgtggattccgatgtcctgcaagatcctcctcacaagtgtcatttcatggtttttttctggcaacatctttttgaaaactccctgtaaagaagtgctgatgttgatgctgaggcccaggaactttggagtttatttacctttttttgttgttttattttccttggcaggtgaagtaggagctagagtttacttattttgaagtttatttgaaatatgctttttatgattagaagccattttagaaatgagggcgaggccgggcgcggtggctcatgcctgtaaccccagcactttgggaggccgaggcaggcgggtcacgagatcaggagatcgagaccatcctggctaacacggtgaaaacccgtttctactaaaaatacaaaaaaattagcctcgcgtggtggcgggcgcctatagtcccagctatctgggaggctaaggcaggagaatggcgtgaacccaggaagtggagcttgcagtgagctgagatcatgccactgcactccagcctgggcaacagagcaagactctctcaaaaaaaaaaaaaatgttatgctaagtgagaggagccacttacaagagaccaccacatgtttggccgggtacagtggctcatgcctgtaatcccagcactttgggaggccgaggtgggtggatcacgagatcaggagttcaagaccagcctggccaagatgttgaaaccccatctctactaaaaatacaaaaaaaaattagccgggtgcagtggcaggcgcctggaggctgaggcaggagaatcgcttgaactcggagggtggaggttgcagtgagccgagatcacgccactgcagtccagcctgggagacagagtgagactccatctcagaaaaaaaagagggcaagaattcacatgttgttttactcacacgtgttggagatggagctcagggtgattcctgactgggcccagggtccatggcctcagaagtcccttaatctgaagtccttcacttttatgtgatactgctgggcacaatggctcacgcttgtaatcccagcactttggggggctgaggcaggtggattgcttgactgaggagtttcaacatggtgaaacaaaaaatacaaaaaactagtcagcctgtagtcccagctatgtgggaggctgaggtgggagaattgcttgagcccaggaagtggaggttgcagtgagccgagatcgcaccattgcactccagcctgggcgacagagcgagaccccatctcaaaacaattttatatgtgatagtttgtccatgtgtatgccagggtctgtcatttagagtgtatggcatgttcttaaaggggtgggggaacaaaaagatactataatagtttgtgaccttttgaagggccgctctacatgaatagatatatagtatgtctgtggtgttaaaattttgtggggcgattaggaaaaacatttccaaaaagtcttagggggaaggtagtaatgaaaaaaggttgagaaacaccattccagagagagggtccaagagctttcctcagttctgaaaatggtccatgatttgcacaaggtaaagaatggctgaatgcgaattaacagcagacagtttcttagaagatttgaaactattgtttccttcccagctattcagatggactgctcgggttcttgttatggattgaggcgagggtagacttaatagtcttgtttcagagtggaatatggagtgatggtaggcatgagtagtgatgagttgcattgtgctgataggttatgaaatgtaaattttttattttttgatatggagtctctgtcgcccagactctggagtgcagtggtgcgatctcggctcactgcaacctccaccttctgggttcaagcgattctcctgcctcagcctcctgagtaactgggattacaagcatgcaccaccacgcccggctcatttttttgtatttttagtagagacggggtttcaccatgttggccaggctggtgttgaactcctgacctcaggtgatccacctgcctcagcctcccagagtgctggggttacaggcgtgagccaccgtgcccggcctgaaatgtaaacttttatatctaaatattttatatagaaaataccaagattttatatctgaaacaccaagattttatgagcctcataacttaagtaggatttgtaattgtaaatgttctttcctcataaatacctgaggtttttttttgaaaggttctgaattgtctcaataatgaaaacttccagacacccaagcctagaggagatgggtagttggtagctttctgtactggaaacagaaacactcaaatatatagaacctagccagctaaccaaagtaggtagatttatagatcatcttaaaataaggctgattacacagtaaatgtcacctttggaatctggcttggtagaattgaaataggcttcagtacctcctgtcattcagtacctgttttcttgaactcctgacttcaggtgatctgcctcggcctcccagagtgctgggcttacaggcatgagccactgtgcccggcctcagtacctctttttaagatgctctcattcattccctggtgaaaagatgcttgaagtgcaagtgcaagtaggtgtggaaagcatggagggtttgtgttgcttcatttgttttggtatttgttttttccaccagtccctccctctggctttctgcctcccagcccagcatatcctgatcttgtagccatgcaggactttgacccgtgtggtggtttgccattgtcttcctccaggtgaagataagacatcattggtttggcttgaggttgtacttttggccttccctgtatatcctcttcctccttatcctctccgtcagcatgcttggttggactctgtagtgaaatgtgtcattctctttattctgactgtccctatattagtcctgtcttcataaaaaatacaatcgtaaagatacaatatctactatttgttaaaagttttgtgctaggccaggtgcggtggctcacgcctgtaatcccagcacttcaggaggccgaggcgggtggatcatttgagcccaggacttcaatactagtctgggcaacatggtgaaacctcgtttctacaaaaaatgcaaaaattaaccgggtatggtggcacacgcctatagtcccagctacttggaggctgaggtgggtgggtcactgagcacaggtcaaggctactgtgagccaagattgtaccactgtactccagcctgggtgacagggcaagtccctgtctcaaaaaaaaaaagaaagctgtgtgctaaatactattttaagcaattataatggattaaaaactcctttaatcttcacaacaatgttttttctttctttttttttgagatggagttctttgaaactcttggattaaatgactcttcagagctttctttgctttttgatactaaggagtggcatgtctggggatttttatagcaaataacttctccttggctactatccttagaattccaagtgtttttaatgaaaagaggagacttgtttttagtgatgttagttgtttttaggaaaggtgttctgcagtgtttttcgctaaggtggctcacgcctgtaatcccagcactttgggaggccgaggtaggcagatcacttgaggttaggagtttgaggccagcctggccagcacagcaaaaccctatctactgaaaatacacaaagtagccaggtgtggtagtacactcctggagtcctagctactcaggaggctgaggcaggagatgacttgaacccgggaggcagaggttgcagtgagcctagatcgcactattgcattccagcctggacgacagagtgagactgtcttaaaaaaaaaaaaaaacataaaatggagaggtagaccagcttacgggaggtgttgcacttccctctgccactggagagactctggatctgcagccagggagcttgtgaaggcttcttgtccacggaaatgagggcggcagttgtgactttctggatggtggcccagaggaagcaacactggcagagcctcttctgtgaagcagctctgcgagcaattttgtgacattgaaagagcaaaggataaaacgttgaaagctgatccagatctagaaaagtgtttggcaattgctggaaaaggtgtagaaatgatgcttgctctgtatcgtaagttatatggtgagaagaccacaagcacggttcaaactccccttagaaattcttttgcacagaaattaacactttaatcctaaatgtttccaatgttttaacttacagtatgctaaataaacattctttctgtttgtttgttttgttttgttttgttactctgtgcatttatagccaatagagtttttctttccttatttttttgacacagggtcttgctctgtcgcccaggctagagtgcagtggtgcgatctcagctcactgcaacctccgcctcctgagttcaagtgattgtcccgcctcagcctcccgagtagctgggactacaggcgcgcgccactgtgccgggctaagttttatatttttagtagagatggggtttcgccatgatagccagggtggtcttgaaatcctgaccacaggtgtgagccactgtatctggccaaaaaaatttttttattttttgtagagacagggtctcactatgttgcccaggctggtcttgaactcgtgacctcaaatgatcctcctgcctcggcctcccaaagtgctgggattataggtatgagccaccatgcccagcttgacaaaaaaatttttttttttttttgagagatgaagtttcactcttgttgcccaggctggagtgcaatggatcagctcactgcaacctgtgcctcctgggttcaaacgattctcctgcctcagcctccagaatagctgggattacaggcatgcaccaccacgcccggctaattttgtatttttagtacagacggggtttctccatattggtcaggctggtctcgaactcctgacctcaagtgatccacctgcctcggcctcccaaagtgctgggattacaggtgtgagccaccacgcccagctgacaaaaatttttaaatgtcattgagcagtatcatttttcccactgattatgagattgctttgtgtgatcacacactgacgggcaggccaattgctgcttgtattcagtatttggccccttatagaaaacatttgcagacccttgttctagaaaaaacagatgggtgggaggaggaggaggagaagcatttcaggagtggctttgggctttcctgtcctgcacgtggtgaggcaagaagctcttgtgcctcagctcatagcactcatgggagtctgtcaataactagaaccctaggagttatttttgcttgttttaaaaataagcttgttttggggccaggcgtggtggctcacgcctgtaatcccagcacttcgggaggccgaggcgggtggacttacaaggtcaggagatcgaaaccactgtggctaacatggtgaaaccctgtctctactaaaaatacaaaaatcagccgcgtgtggtggcgggcgcctgtagtcccagctactcgggaggctgaggcaggggaatggcgtgaacccaggaggcggagctttcagtgagccaagatcgcaccactgcactccagcctgggcgacagagcgagactccatctcaaaaaaacaaacaaacaaagcttattttaatggatataaaaacatgaatgaaataagacaccaagttcaaggtggtagggggttaatttggaagaggcagagcaaatgtgattgaatgaggggtatgcaaagggtttctgctctatccatatgttttatttattaatttatttttggagaacaaagtctcgctttgttgcccaggctggagtgcagtggcgtgatctcggctcactgcaacctccacctcttgggttcaagcgattctcctgcctcagcctcccgaggagctgagactacaggcacgtgctaccacacccggctaatttttgtatttttcagtagagatggggtttcaccatattggccaggctggtctcgaactcctaaccccaggtgatctgcccagcaggcctactctatgttttagtccttgagaatgttagaatttgatgacactgagatgtggatataccagacatggggtattttctgtactcatcagcatatttgaaatatttcattaaagttcttactttgcaaagtagacacagctgcaattatgcatttttggaaaatgattaggtactatctcatctgttttgtttttttgtttttttgtttttgagatgaggtctctgtcacccaggcctgagtgcagtggcgcaatctcagctcactgcatcctctgcctcccggtacaggtgatcctcctaccttagcctctcaagtagctgggactgcaggtgcacaccaccacacccggctcattttttttgtatttttgagctcaagcaatttgctcgtctcagcctcccaaagtgctgggattacagatgtgagccactggcccagtactatcttgctaagcctataaaattagattagattggtagtacttgggacccctcagaattctataatgtccttcttagaaggtgacagcagatctatccagcagactgtagattgttgtcttagtcaccggctgattgtcttggttaaagctctagtgacttcagaaccagagaaacttgttttccaacacattcaaagaccagtttgctttgcaattttgcaatagctgacattcagaatgcctgcgaggattttgtaagtgaggttcatatttcggataatgtgtgacttttgccatttctgatgcttttccaaaagaaagttactcttccctaaaggcaggaattctacttttgcttagatattctgaagcttatgagttcatccaaatttggttcctttcagcattttcctgttggtccgtctccgttttgaaaacatacagaatgtacttaattttgccctaccatttgtgagcatacaaaatagcacttgagtcatatttttcatgattgcttcccaatactattctaagaccaacatagcattttgtcatttcataataatagaattcctcattaaggaataactttctaaaaatgtgtccagcccatttcccccccagccctggccgtttcctttggtatgttggtgtccgtgaccctgtcattgagtgtgactgaaaacagaggcctggcagagggcctggcctttgtgagccctcagattgtgataaagaccctgaggaatgttttggcttttaggcaacctcagttctgttttcctgctgcctgttgatgcagtggctttttcttcccatcagtctgaagggtcgtgttagtgcctgggctctcatcagaccacagggaactcatcctggcactgctggctgcctcactttaaccacctcaagtctcagcattctcgtttgtaaagcggagatattattacgtgattcacagttttattgtgaccattagaggtagggcacatgatatgccaggcatcatgcttggcgaaggcaataagtaatgcagccaggtgctgtggctcatgcctatgatcccagcactttcagaggcggaggcagcaggatcacttgagaccagcctgggcaacatggtgagaaccccatctttacaaaaaattaaagttagccaggcgtggtggtgggtgcctgtagttccagctactcaggaggctgagatggaaggattgcttgagctcaggaggtcgaggctgcagtgagctgtgatcatgccactgtactccagcctgggtgacagagtaagactgagtctcaaaataaataaatacaaggtttttgcagaacagtgaatgagaaaatgcactgttgttatttgtggtggaagtgaatactatatggcctgtgtttcctgaaggaacactgcctccattaaaacaaatgagcaaacaaaatcccttttcatgacttcagttctctcaggcctgagagtaaagtttacatcatagatgcttaaaaacaattcagttagtgaaagcatgtgacaagatgagacgatttgtcttcaacgaggagcttccttccatactcacaaaaagatgtgtgtcttaacatagtaaggacatggttaaatttagtcttatttggacctaacttcagccaattaatctgctacttagaactcttttactcaaatgaaatttgagtaaaaaaaaaaaaaattttttttttggccaggtgcggtggctcgtgcctgtaaacccagcactttgggaacccgaggcaggtggatcacctgaggtcaggagttcgagaccagcctcaccaacattgagaaaccgcgtctctcctaaaaatacgaaattagctggtgtgatggcgcagtcctataatcccagctactcaggaggctgaggcaggagaatcacttgaacctgggaggtggaggttgcagtgagccgagatcgcaccattgcattccagcctgggcaacaagagcaaaactccatcttaaaaaaaaattattataataattttcaagtatatacaaagcagtgacacattttgtaaacccccatgcaccatcacacagcttcaacaactaccaacatctgtctttcagacatgtttttagtccaagttttctcttaataaagagactttttctttttcttttttgtttgtttgagactgagcgttgctctgtcgcccaggctggagtgcgatggcaagatcttggctcactgcaacctccgcttgcgggctcaagtgattctcctgcctcagcttcctgagtagctgggactacaggtgcccaccaccatgcccagctaatttttgtatttttagtagagatggggtttcgccatgttggccaggctggtctcgaactcctgacctcaggtgatccgcccacctcaccctcccaaagtgctgggattacaggcgtgagccaccatgcctgaccataaagacatgtttctaaattctcctgggacaacagtgaagttctacctttccttcctactttaccgaaggaacctgaaaataaggctgctttctgaaacttaaactactaagtcagtgatatttagagcagatgtaagcagctgtctagacacagaatggcttcccaggctcgcaagacttgtcatgaagcccccagcacgtcaacagaaagcatccaagctagaagaggcactggctcacagcagcaccccagaaaggaagcgtctcagggacagatcgtgaccgtgctccggaagagctgtcctcagccgctactgtgagcatttggcctgcctgacagattctgttggtgagaatgttcttaggaatcatacagtaaactaactttattctgacttcaagcatcgtgttccattgatgcttgctttccaaggtgttttgctgattcacatcagcatgcaacctgcttgacagaatacagtgatgttctcactgtaaattcatcacctgctgctgtggtctcatgtatcatcccgtgcgctgttagctgaggccagtgctcctgtgtctcctcagcacgagggcactggcaagagtgcatgtctgggcctataaagatgttggccaggttctaggcagggttgaattcaccaaggtaactgccatccatccctcaataggcattttttctcctacacaccctcaggcacatgccacgtgtacctggcacccttacttacgaagttaccgaattcctgccatgatactgtgggtcaccctgcttcattctcaggtgtggtgtcgggtggttcctgcctgggcgccgggtgttgttgggccctccctcaggttattggtttttgttttgagatgtaattcacatgccatatgattcacccatttaaggtgtacaatattcccctgaagtttattgtggaaaaaggctgtgtctgacactgcttaggaagctaagacacaaagcagccagaggggctgccagggctcactgtggcagggcggcggagaggctgctggcgcctctgtagctgttgggtgctcttgccttgatgctgttttcagctttggattgtaattgggtcccacgtgggtcctcttcatctcgtcttgttggtggcagtgttgctcccagcgttggggtgggcagagtcacacaccagaggacctcctcctgctgttttctctggaccttgttgattatgtgttttgtgacctttggcatattgtacctgttccaggtgtacagccagctggttttggttgatgtgtaatggacaaaaggtgcccctatttaaaaaaaaaattttttttctgcttgtagtcccagctactcaggaggctgaggtgggaggatcacttgagcctaggaggcaaggcttcagtgagccatggtcctgccactgcactccagcttaggtgacagaggaagaccctatctcaaaaacaattatataggccgggcgcggtggctcatacctgtaatcccaacactttgggaggctgagatgggcggatcacctgaggtcagaagttcgagaccagcctggccaacatggtgacaccccatctctactaaaaatacaaaattagccaggtgtggtggtgcatgcctgtaatcccagctacttgggaggctgaggcaggagaacagcttgaacctgggaggtggaggttgcagttagcggagatcacgcctctgcactccagcctgggcaacaagagtgaaactctgtctcaaaaaaaaaaaaattatcataaaatcactcgttttaagtatatcatccaaggattttagcaccttctacagagctgtgcagctattgccacaatccaattttagaacattttcatcatcccctaaagatccttttacccatcactccccattcccacccccagtaccaagcagccactcatctacttcctgtgtctattgatttgccttttatggacatactgtacactttcattcatatgaagtgtctagataaggtaccctctaacgggtgacttttcatggttagcttttttcaaatgatagggaatttcctgcttcagaagatgctttttctgctgtgctacttacctgtgatctattgtgtgggtgggatttccttggaggcatgtatgtgtttgtttgttttgcagagtagcaaccttttttgtccgttgattagtgttctgtggaacatctggtttcatgcccatcactgtgacatatttggggagacacaacagaagatatatccctagtgggtgaaacaaacctaacaaacatgaaaacaactagcgaggagtcaatgacaacatctaagcaagcgtttggctgtgggatgcttttattggagacatgtttatcaagcatcctgtgccaggccctgtgcaggttggaatgcccttgtgctgagcaggcagaggtgggtgaaggccagggttagggaggggtgataaccgtgatacaggagcagacatggagccacacagccaggctgttttcttttcaggtcgccttcaatccttccagtggaaaggcttattttggtgcaggtgttgcttctagcaattgtttctctctccctttcaagagagcgtaccgaccttttgcaagaagtgtttctggctggaattttataacattggcttttgtttcccttttactaaagtagggccagatttgagggtgccttgaaacccaggcccatcttggtgtgcccaaataggagctgtaacaagccgtggtgcaggggtaggacctgtgttgtctttggagccatgggctgggctgcaggcactcgagttaagaagcttccttctgaggctcttccagtaatttgagtgtcctgtggcctgcctgggcagagagtggacaggaaagatcaggaaaagcacgtgtgaggactaccgagggtgctgatagcgcctctccttcccaacttcacttctctggctctgacctttcagccctaagctccccttggccctgtgggatggggcagcatccagaagggtcttggagtcaggttttgttttgtttttttttttttaagtcatgtttccattgggcgtagtggctcgtgcctgtgatcccagcactttgggaggccgaggcaggcggattgcttgatctcaggagttgaagaccctcctgggcaacatggtgaaactccatctgtactaaaagttcagaaaaaaaaagcccagcatggtggcgcacgcctgtagttccagttgcttaggagggtgaggcaaaagaatcgtttgaacctgggaggcagaggttgcagtgagctgagatcgagtcaccacactccagcctggcgatggagtgagactctctctccaaaataaataaataaagttatgtttctacactggatgtgcatgtcttcaataatggggacaggggacaaaacacacaactgaaatacagttcagtgggtgggttgctgtctttattgttgggtgatgtgtttatacaaggaaggaagcactgagtgggcctgttgacgatctgggcttgggaaacagctcacaggggaactgctggaactcaaggctctggttctcctgggggatccatgtacaggtctgtgcgtgtcctttgttgccaggattgccctgccaagctaaccgggttgtgcttcgcgtttcagacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacaggtgagatggcagtagttggagcttttgtttttttccttttttttttttttttttttttttttgagacggagtcttgctctgtcgcccaggctggagtgcagtggcgcgatcttggctcactgcaagctccgcctcccgggttcacgccattctcctgcttcagcctcctgagtagctgggactacgggcacccaccatcacgcccaactaattttttgtgtttttagtagagacatggtttcaccttgttagccaggatggtctcgatctcctgatcttgtgatctgcctgcctcagcctcccaaagtgctgggattacaggcatgagccactgcgcccagcccctgctttttttttagacagggtctcactgcagcctccacctcctgggctcaagcagaacctcccacctcagcctcctgagtagttgggactacaggcacatgccaccacaccttgctcattttgaaattttttatagaggcgggggtctccctatgttacccaggctggtcttggactcttggcctcaagtgatcctcccacctgggccttccaaagggctgagattacaggcgtgagccactgtgcccagccagattttgctctttagagacaatttattaactggaatgtggatactttcctctctttattagttcttgacagtggaatctgggtgacgttttaaaaagcagaagaaacaggcaccgtgtgaatgtcctggtggccgtacagtggtttcacagcagaccctcactcctcctcttcccagaaagggagcaaaacaacagggcagagctggggccagcgtgacccagcttcctttctcccactttactaagtgcaagtttcagagcagaccaaagaggaagtagccttgccttcttgagcagaggctttttgatccactccgacagggctgcccctcttgttccctgggtatttgggttattttattttattttgagacagagtcttgctctgtcgcccaagttggagtgcagtagagcaatctcggttcactgcaacctcagcctcctgagtagctgggattccaggtgtccaccactacgcctggctaatttttgtatttttagtagagatggggtttcgctatgttggccaagctggtcttgaacttctggcctcaggtgatctgcctgccttaacctcgcaaagtgctgggattacaggtgtaagccaccgcacctggccgctatttgggttatttttaattgtgggacaagtgacttgaatagctcacccagccaagttaccgatcaagttaaaacaaacatacgtcctggaatccatcctctttgcggccctcacctgcgaggagttctgtggaatcaaggtaattttgaccctgataacctcacagtttaaattaaaacctaaacctcccagcagcgtgccctggctcttagctgagtgagaaggacttcctgagagctggtggtgatgagacattggccctttggggctgctccatcccgagtgttccagagacccgagggtttggccatccaaatcctatgttaaagattttcacttttttctttttttctcgcttagtcgcctaccaggctggagtgcagtgatgtgatcttggctcactgcaacctccacctcctgggttcaagtgattctcgtgcctcagcctctcaagtagctgggactacaggcgtgcacctccacacctggctaatttttgtgtatttggtgaagatggagtttcaccatgttacccaggctggtctcaaacgcttgagctcaagcaatctgcctgcctcccaaagtgctaggattacaggcgtgagccactgtgcccagctaaacatttcactttaactgaaaaaacaaacaattacactggcctttaagtaaaaaataaataaaaatattttcagcggcactccccctaacatgtttttttgatgacttggtgttgtctctgtgagccaccgttgacccagttactgtatttctatcgtcagctgtgattcattatgaaggaggacttgggagaactatcttttgctaccttttctgagctatcccagtcaagagttgcctttagcaaatgtatctgtccatcctggctgtttgttacctcctcaggaagggagctgaagtgttgagaactcaggcagtagacagtgaacatagccaggggacatgagtggctgtgtgttcctgggagcaggcaggttagctgtctccctagagtccggccccgccttgcaggtccagaaagcacatattggcatctgactggctgcaatgtgtgtctctcgaggcgctcccatgtgagtctgtaaagagctaaacactgccagggctgctagtgcctggggtcctttgccggcatattctctcccaggcaggcaggctctgtgggaaggcaagtgagaatgagactgccagtgtattaattcatcatgagaaccaggaccgccccggggagcaggcactcgtgtccccgggcccacgcctttagtccgcataggcaagtctctagtccagttgccagaagactgcttgatgaagagagaggcagaacgcggggagctggtttgcaaggtgaccgtttaatagcatcaggctaggccaggcccgaggatgcggaggagccagggttccctccatcttggacgaggtgtgggagataagcgctgtgtaaaatgtatcatgtgggccgggtgcggcggctcacgcctgtaatccagcactttgggaggccgaggtgggcagaccaagaggtcaggagatcgagaccatcctggctaacacggtgaaactccgtctctactcaaaatacaaaaaaaaattagccgggcctggtggcgggcgcctgtggtcccagctactccagaggctgaggcaggagaatggtgtgaacccgggaggtggagcttgcagtgagctgagatcgcgccagagcactccagcctgggcgacagagcgagactccgtttcaaaacgaaaaatttgtcatgttaacctttaaaaaaagtgtcgtgttttgttttgtttttctccccccaaagagattaggtctttttatgttgcccaagctggtctcaaactcctggcctcaagtgatgccccccacccttcacccagtgtaagcactggtattacagttgaattagttagatgagttgatacagttaagcaattatttggccctggaagtcactgtgttttgattgtttgtttctttctttgagacggagtttcactcttgttgcccaggttggagtgcaatggtcaatggtgtgatctcggctcactacaacctctgcctcccaggttcaggcgattctcctgcctcagccacccgagtagctgggattacaggcatctgccatcacgcctggctaactttttgggtttttttgtttgttttttgagacggagtctcactctgttgcccaggctgagtgcagtggtgcgatttcggctcactgcaacctccgcctcccgagttcaagcaattctcctgcctcagcctccggagtagctgggactacaggcgcgtgccaccacacccggctaattttttgtatttttagtagagatgggttttcgcagtgtcggccaggatggtctcgatccctgacctcgcgatctgcccaccctggcctcccaaagtgctgggattacaggcgtaagccaccgcacccggccctaacttttgtatttttaataggttttgccatgttggccaggctggtctcaaactcctgacctcaggtgatccacctgccttggcctcccaaagtactggaattacagccatgagccaccacacccggccaagtcactgtctttttaaggtcactttgcacatctctgctctgattccctgcaagttaatcttaagtttcctcttcgggaggcaatcttggttccttatttccaagttgtggtctggcatgcacattgaaggtcccatgtaaaggagaagtggatgctgtggtgagaggcgcacagggccagctcattctttgtccctggcagtctctcgaaagctctttcactgtgctgtttctttgtccccttgcagagaatgccacgggtgacctggccaccagcaggaatgcagcggattcctctgtcccaagtggtaggttcttaaagagacccgcgatggagtgaggccaccggatgggtcattgtgaaaggacacttgtcatttgggaactgtcacaggcttccctctcatggttctgtttactcaaaattggcaaaccgggggctctgcctgggctgccggcttctggctccagcatccttatgggggagtttatactgtccagctgacacaggggccggggatcctgcagcacttcctggctggcccccatctcctcctggaggatgggatggaggtggctgctgcccatgaggctcaggcccctccttgctgtgcgggcctccagctgctctgctgaccccactccccacccaccctcctgtctgcctgttctgtctcctctgcttcctttgctccctgttgccatcgctgtcccctgccccgtgggcatcctctgtcctctgccacccccgcctccccgccactgcagcttgtgatctcaagatgtgtgttagcttgctttgtagtgctggcggctgctgccccattcctcctttatggtttaaggactctgcatcgggcgcctggggtgagtggtcccgatgcactaccaggtagcaaatgcaccctcggggcagacctcaggccatggactctgggaggctgctgtggagggggtactgcaccgcacccctgctggaggatgggactcccccggcagctgctacccaccgagtgcactgtagctcagcagctgttgggccggctggcttgcagagtgctggggcgttagggtggtcactttccagctttgctaggcctggagtcctgtgcctgtcctggctttgctctgcctggctccctgtttatcctctgctagcccccccacacaccagctctggtttccatcttgttggagaggaacatgtccccctcactgtattagaaagtgtgaacaagaccgtgttccctataatattaggagctgtggcaggcttggtttctataggaaccctgaggtggcggcagggccaccacatccagcactctcagtgtgtgcgtagagcccattagggctggggtgacgtggcagagccggccatggaaggggctacacaccccttcttaaaggcgtgtccacactcctcagtgggcccttccagacccagacccagctaggcctgtgtcctgtgtccggcccagcctccctaacacagatgtttgtgtttcagctcccagaaggcaggattctgaagaccactccagcgatatgttcaactatgaaggtaaaactccaaagaggccaggtgcggtggctcacacctgtaatcccagcgctttgggaggctgaggtgggcggatcacgaggtcaggatatcaagaccatcctaacatggtgaaaccctgtctctactaaaaatacgaaaaattagctggacgtagtggcatgcacctgtagtcccagctactcaggagactgaggcaggagaattgctcaaagcctgggaggcggagggtgcaatgagccaagattgcgccactgcactccagcctgggcaacagagtgagactctgtctcaaaaaaaaaaaaaaaaaaaaaaaaaaaaactccgaagaaacttatatatggggcaaaacatgtattcttagttgggtattgagagacacttgcggattttcactgaggaagttgtagagcagggctctcccctccccaggtggtggcagccccctgaggttggggtcaaggtgacaggccccacgtggatgccgccagcagtgggaaggaggctgcgcctgtggagatgtgcgttagaggcgtagcctggcacgtggctctgcaatttacattgtccctgaacctctcgccagcggcttggctgtgggcaagtgactgttgccccgcctcagagttcccatgtataaaatgaagggtcccagataggtctcatagagactcagccactgcatgtaaaaggcctagaacagggcttggcagagagcagccttcaaagctccgaagccgtcacctggacccaaggagcagcgcgtcagagccgctgcactggtcttgggtgtaatttacaggcttctttaccagagagatgtttctccgtctgctggagccgcaagcctcctcaggcactttctggcttgcttcccctccttgcgggccctactaatttgtattccctgggctgtcttactcctagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgtaagtctgcagcccctcagcccaggaagccctgcccttgaggaccccggtccatctccccatccctaaaatatgaaggccttggaaatgctgttcttgggcccaccagggcagcaaggcctctaagccccagaaaagctggaagaaagcccctcagaaagagctccccatggaggccctggctgaggggatcccctgcggcagctctgtggaatgggggctgtgagctgacctcaggctgtgtgttctcttccaggccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagtcatgtttctgcgtgagaatggcgaggtggtggtttgtcccaccgttcagtgtacacagttggggctggagtgagtcagtcacaaggcaggccctgcccaggcggcgtgggtgactggggatgaggtcttcctgttgagcatttgaggactgctgcacacgggcctgaggctggcctgaggtgtggagggagcgctgctatgtggggcataagagttggtcacgggtgacaggacggaggaccacgggccagggtgtttcccaacacagtctggtctgagcgggaggccaggcctctggcctgtgtttctgagcttgagttgcaggtgataatgttggcacaaaagacctgccatgccagtctggcctctttctccacctgtttcccggtgaaggagccaggacctggcctgcgagtctgtcctgttctagcagtgaagcctggtttgccaggcacggggctgggaagcaagcagtctgggtctggagggtggccccaaaaaggccaactctgcagctccacagccacatgggggaggctgccacaggtcacactccttagccggatcccctcctgaagaaaagcatctgagctgaccagcgagactgcagtggggcagacactattaaatttgctggcacagctctgagtaccccctcgcttccaccctgacttcatcccgcagtagctctcagccctcccagcccctgcagggccacgtctttctctattgccggtcagcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactgagtgcccgtgaactttcgccaaacc

SEQ ID NO: 9734 - DNA, 125 bp, Homo sapiens
cagctactcaggaggctgaggcaggaggatcgcttgagcccaggaggccgaggctgcagtgagctgtgatcatgccactgtactccagcctgggtgacagagcaagaccctgtctcaaaaaaaaa

SEQ ID NO: 9735 - DNA, 249 bp, Homo sapiens
gggaggccaaggcaggcagatcacctgaagtcaggagttcgagaccagcctgaccaatatgatgaaaccccgtctctactaaaaatataaaaattagctgggagtggtggcaggcacctgtaatcccagctactcaggaggctgaggcagagaattgcttgaacctgggaggtggagattgcagtgagccgagattgcaccactgcactccagcctgggcgacagagagagattccattaaaaaaaaaa

SEQ ID NO: 9736 - DNA, 322 bp, Homo sapiens
cgataacagtagttggggtcatgccccctcattccttcagtaaattttaacggagcaccttttatgttccaggcactgcattcagttctggccattcaaattgcctaagacatggtctctaaccccggggactgaacttcccagagagcatttaaattttgtttcctgctgctctctaccccatctggttttcgggtcaggaatggtctggtctctctctctctctctttctttctctctctctctctctcaaattaaataccaactatgtactggacactaaagattacaaaatgaataaaactccgtccatgctcttgaa

SEQ ID NO: 9737 - DNA, 282 bp, Homo sapiens
ggccgggcacagtggctcatgcctgtaatcccagcactttgggaggctgaggtgggcggatcacctgaggtcaggagttccagaccagcctggccaacatggtgaaaccccctctctactaaaaatacaaaaaattagccgggcgtggtggcgggtgcctgtaatcccagctactcgggaggctgaggcaggagaatcgcttgaacctgggaggcagaggttgcagtgagccgagatcacgccattgcactccagcctgggtgacagagcgagactcctttc

SEQ ID NO: 9738 - DNA, 103 bp, Homo sapiens
cccagcactttgggaggcccaggcgggtggatcacaaggtcaagagatggagaccatcctggccaacagggtgaaaccccgtctctactaaatatacaaaaaa

SEQ ID NO: 9739 - DNA, 1675 bp, Homo sapiens
aggccaccggagcccacagctcaacaggcttgggtccccttccatgctgtgggaagtttgttctttcgctttttgcaacatagcttgctgctgctcactctttggtttcgtgccgcctttaagcgctgtaacactcactgcgaaggtctgcaacttcacttctgaggccagccagaccatgaacccactgggaggaataagcaactctggacacaccatctttaagaattgttaacactcaccaggagggtctgcggcttcattcttaaactcagcgagaccaagaacccaccaattccggacactgtggagagggaccagtggtgggcagggctccagaactccaaagatcgtatgttctttgtcttctgctaccagggtggatatggaaggaccatcaggtgggggtggggctaggcgtgcctgagctcagactctccttgggtgggtcttgctttggctgctgtgggggatagaggtgagattcccaggtcagtggagttgtgtacctagaaggattatggctgcctctgctgagtcatgcaggttgtcagggaagtgggggaaagctagcttccaggcacgctgaaaggctggtctcactcccacaatgccccttgtgatagcccggagtctgtttccaggccgaaggcgaatctggcttgaaaacttacctgaggctttctgcctcccgactgacaaagaaatgggcttcagttcttaccccgcctgtgaagtctgcaagcctgattcacgccctcccccgagttctggccaggaggcttccagccccattcaattttttacaaagttcagctagagaggttcttctccctgtgaagttttaccccctgctcctctggccacccccccgatggatgtctgccgtgccaggcaggaatgggctacttggggatccagcggccttccagtgcctttgtgctacttcctctactcctgtatgttgctcagctcggctctctaacttgactcagctccaggtaaagtcacgaacttctcccacaaacagactttcagcttctccagtgggggtgtgtgttcatgagacgagggtctccctttcccatttccgtggttaggggacttaaagtatttggggtgtctcccaggtcctgcaagagcagtctgcttccttcggagggtctgtgggtcctgtcaggattgctggtctgctcttgcagtccatctggagctaaaattcacaacgcaagcctccgcatgctgctctgtccagagctgccatctagttctgcctcctgtctgtcataatccctcatgacccttgagctttttttttcatatgattgttggcagcatgtatgtcttcttttgagaagtgtctgatcatgtttttgcctatttttaaaggttttttttttttgtaaatttgtttaagttccttgtagatgctgtatattggatctttgtcgaatgcatagcttgcaaaagttttctcccattctgcaggttgtctttttgctctgttaatagtttcttttgctgcccagaagctccttagtttaattacatcccattcgtcaatttttgcttttgtcacaattgcttttggtgtcattgttataaaattttcgcccgtgcctatgtcctgaatggtattgcctaggttgtcttccagggtttttatagttttgtg

SEQ ID NO: 9740 - DNA, 131 bp, Homo sapiens
tttttttttttttgagatgaagttttgctctgttgcccaggctggtgtgcaatggcgtgttctcagctcactgcaacctccgcctcccaggttcaagcaattctcctgcctcagcctcccgagtagctggg

SEQ ID NO: 9741 - DNA, 556 bp, Homo sapiens
gcaaggagttcagggtaaatgtctagtgtcaaagttctggcaggctttactggggaaagtggtccccagttggtgtgagaaaaaaaaaaagtagaaatgctgattcccatgatctggtaggattttgattctgcttctgaatggctgaaaagctttccaaaacagcttccatggtttatgccacttttatttatgtctcttactcttttgtggcagagtggttgcagtaggaagtgaagaaaaaatttatccttaccacaccttcctcccaaaccctgttagttcaactaggtaataagcccaccattaggatgcctcagaccataaggagctgttcatttcaggactgttcctcaggatatgggcattgatttagttaatttggcaagtcttcacaagtattatcttttaaagtaagacctacacaaaaagaagcagtctcattagaagaactctgaggcctgtgcaaagaatgcatgtggcttcagagaaaatgctactttgaaaaagcatctctgagtctttaaataattaagaggttgttagagcaatgggg

SEQ ID NO: 9742 - DNA, 556 bp, Homo sapiens; identical to SEQ ID NO: 9741

SEQ ID NO: 9743 - DNA, 1051 bp, Homo sapiens
tggcactccagctggtcctgcataggaccgagcctgtgcctgtggctcctcaggcagagtggcaggtgtttgcagtaagcagtgtcagctattactactttatatttgactgatactataacaccagtatgatcttcctaaatcatataacaaaatctaagttaaaataacaaaaatgaaatacaatgactattcatgggtatttggtattgtgctaagtcctagacagttatttggataattgcaacaatatttacaccgtgacatggtttggctgtgccccacccaaatctcatctggaattgtagctcccataattcccacacgtcatgggatggacctggtgagaggtaattgaatcacaggggtgggtttttcctgtgttgctatcatgctagtgattaagtctcatgagatctgatggttttataaacggcagttcccctgcacacactctcttgcctgccaccatgtaagacatgcctttgcccctcctttgtcttctgccatgattgtgaggcctccacagccatgctgaactgtgagtccattaaacctctttcctttataaattacccactcttggatatgtctttattagcagcatgagaatggactaatatacactggaaactgagacttcatttggtcatttttgacaccatgccaccagaataaaacaggtacaggataatggatcctaccattgattggaaatgatcatctgcaggaagagcaccaatggaatacaaagggtggaacccaaatgcctctatttcagcatgtccagtgtcaaatgttcaaagaattgtatagcactttatataaataagactccaataattaaacttttctatatttctctgtcacttaagggatcttggaagctgagtttcctttggcgccaaagagaacatggactggacagaagaatttggaagtcataagtacaaactataactttaggatttgttacagaaataagtattgtatcttctactatattttcatttttatggttttataaataattctaaaatgcagctaattt

SEQ ID NO: 9744 - DNA, 159 bp, Homo sapiens
aaaagtaagtaagtgtgtgtcaagccagccttctgagggaaactggatcccatctcatagggaaactctggagtgctgtatatgtagaatacacatcagagttggtcacaaatgaggaagatagagattttctcttcttcctttcttacccaccaactt

SEQ ID NO: 9745 - DNA, 1606 bp, Homo sapiens
cccggcaccagtgagttatacctgagttaatcaaaaactctgagctgcatcctggccttgaacttcagtggatttgaaatttatcatgtataggtcattttcaagtggatgcatgtaagaaatgcattctctttaggggtcctctcacctccccgcaaatgcagcccacctcttgtgcttccaaagccctgggagaccaagccactcacctgggaactgatagccatagcttggagcaaatccggggtagccacggccataggtcgccacgaagttgggatatccttgaacacaaagagaaagatcagagtcctgttagtacagccgcctcaggtctggggtaaaatctcacggagggtggcaatgaggaaagcctgagttattttccttcacagaataatttgtctctcatgagggtttttttattaagggtctgggtcacctctctcctgtggccgggggcgctgctgtcagctgttgctaattaacccatatttgggcagccagaccccgcaaagcccatgtactttcctgaaccttcagagtaaatgccatgcatcagcaccaaacacaaagcctgcgcctggctctgacatttggagagcttaccctgcatgtactttaccttaaagctattgacagtaggagattaaagtcctcgtgatgcatcctcccaaggcagtggacaacagagccagcaccagacagagcatgcgaactcaggagtcacagtttagcggccaaactcagggctcaccctgggcctctggaaaacgctgggcctgatgagccatggcccacactgcagttttgacactccacggaggtgccaagatctttggagaatggtgagaggctggatgtgttaagatgcataccacaaagtgtagctccgactcaggagccccgtgccgtgtgactggatgggcgtttcaccacaagcgtattgtttctagacccctgtctcagcaggcaagctagggggtgagtggttcactgaaagacacttgtagaaactgccactgggctggccactgggcacacaagaaactcagctggcaagtccaggggctggtgtgaccatctcagatctgtcactaacccccagtgatgtgaggtgtcattcagctctcagggagtcattgtggctgctcaggccacttcgttcttcaagtccctgcctgattcaggctaaatgaaggccgtatgggtcaggctcactctgcctccctccactcagtgtatatgtaacctcagtacattcttgctcttaagatgccaccacggccacccaaccaccgagaacgtgactttcgctttgactttggaggtgaatgtctgtggtcattttttggctgcccagcccctgagcctctccctgtgtgtaagtcttggagagaggcccacccccccggccatcacagaagctgagaaggcctcagggctcttcctggggctggaggctgggaggcaggcctgtgaacctgggctcgacagacggaagccctccttaggatctgcctctggagctggtagggcagaggaggagggactggctccgaatttattctggtgtcagtagcagaatctggcatccagtgttggc

SEQ ID NO: 9746 - DNA, 1606 bp, Homo sapiens; identical to SEQ ID NO: 9745

SEQ ID NO: 9747 - DNA, 9085 bp, Homo sapiens
acatttcaaggtgttcatgtccagtggatttccatgatgtgaaatgttgccaagaatccaatcctcaaatgtaggcttactaatgtttcaaatacctgcaggctagtatgatggtgactagtatattcgccatttttatttctttatgacatagttatgagcatggtggtgatagcaagaagtgtttttgaaagatcaatgcaaaataaaaataaaaaccaattcaagaagaattaggaaggcacaaaaaaaattgagtatgctgataaagagaatgaattagtctgggtaataacgaaatgaaaaagaaaaggaagactaaaaggtacaccgtgaaggaaacatacaaaggccttcttaatgaattggatgtcagttacccttagaagctgctagtggacttcctaggactgcgacgtgatcctgatccagggcagtgagtgcaactccatttcgagcgttaccagatacaacagccttgagcagcagtgatttaactaagctctgatttttttctgggtcagctggacgtattggtatcaaggtttcatatatacaaccatcagagcctgttggaaacaagcatttgttgttggttattgaaggatacttctatatctattacagttaaatgtactaggttgtttataagattttaccaatttgataaaacagccaaccagaaaaataaacaatcccatcactgtgctttctcttaaagagtaccacaaatttaaactggggaaagaagtactattaataaaaatctcagtaagaaatgtaatagtcaagaaatacaaactgtaaatacctgcaataacttaaaatattgagggggactcccaagaatatagatcatctagtccctaaaaggatatatccctcattagaaagtaattagcatctggtctatacgttacctttctttcttgtttgtttttttgagacagggtctcactctgtggcccaagactacagtgcagtggtgtgatcacagctcactgtagcctcaacctactgggctcaagtgatctatctttcacctcagcctcccaaatagcggggactacaggtgcacaaacctcacccagctaattaaaaaaaattttcttttagacatagggtctcgctatgttgcccaggctggtctccaactcctgggctcaaatgatcctcctgccttggtctcccaaagtaccgggattacaggtgtgagccagtgtgcttagtttattataattcttcctacctcatcaccctgaaaaccttatgaaattgctctttcttgtgggccaactgaatttcggcagtttcatgtggttctagcaattgttacgtaaagatttatataaccctttggtgcacacttcctcacttcaaagttcattaagctaaacattaagtacattccaatagcccccaagatatgaaaatgataggagccttttaaaaaatagccaccgcaaacatttgcacactgaaaaacttcacaaagatttttaattgtgataatatggaaatgtttcctatgtattgctcttgtttacttctccttcaccttctcagaacaacttcaaaagcagccatgaagggtggaggggagagggtaccacaaagacttttttttttcttccccgccctagaggcctaagactggggttatactttagaccatttcataaaggtattacaatctataataaaaagcaactggcatgggccaaagctgctgttagtctccttttgcccatctgtctcagttgctattcaaggaagggcatactaaatctaatggttggaaaaaaggagcagaggggccattcaatgccaagcatagacagtttatgtttcactaattacactcaaagaacctgggccttatcagctaaaaagtgatttctctttttcactggtattaacattgttacttattgcttatggtaaatttttttgttttgttttgttgagacgagtctcgagtctcgctctgtcccccaggctgcagtgtactggcacgatctcagctcactgcaagctccgcctcctgggttcacaccattctcctgcctcagcctccagagtagctgggattacaggcacccgccaccatgcctggctaattttttgtatttttagtagagacggggtttcaccatgttagccaggatggtctcgatctcctgaccttgtgatctgcccacctcagcctcccaaagtgctgcgattacaggcgtgaacaatgcccggccagcttatggtaaattttaagacataaaatataaagaagcaatgttagaaaaggatgctgtatctaaagtacttcaataggccctcaaaacacaggatcactgatctaatgcatggccagacatgcaaagtacaaaaagcaaaggcatgggccgcacgaggtgactcacacctgtaatcccagcgctttgggaggccaaggcgggtggattacctgaggtcaggagttggagaccagcctgaccaacatggcgaaaccgtctctactaaaaatacaaaaatgagccagatgtgggggtgggcgcctgtaatcccagctactcaggaggctgaggcaggagaattgtttgactctgggaggcagaggttgcagtgagcagaggttgtgccactgcattccagcctgggcgacagagcgagactctgtctcaaaaaaaaaaaaaaaaaaagtgaaggcatgaacgctgtaaagaagcacagaaatggctgtaactgaatgcttcacaaagtctacgattcaaaaacatacactatcctataacaatcctctatttataatctctgaaagtttaaagaaagaaaacttacttaatgacatcaaagagatgaatttccgatctacagatgcagtaaaactctttataacagagttttcgtcttgtccaagtaagagtgtatatttggttaagatacgtgagttaaacatttgcacgtaagcaaagtaatttccatgctgcaaaaaaaaaaggttattttataaatattcccatttcaaccaagtattttaacatatgttaaaaccagaagttgtcaccccattctacttacatcaatgagtacttaaaaacatcttatgctatcaaatttgtttgttttgagacagggtcttgctctgtggcccaggctgggctaccgtggtgtgatctcagctcattgcaacctccacctcccaggctcaagcaatcctcccacctcggcctcccaaatatctgggaatacaggtgtgtgttaccatgctacactatttttttttttttaatagagatgaggtcaccacacccagccttaaatttaaaaggtcataaaaaagttagaggctgggcttggtggttcacacctgtaataccagcactttgggaggccgcagtcggtggatcacaaggtcaggagttcgagaccagcctgaccaatatggcaaaaccctgtctctactaaaaatacaaaaattagccaggagtagtggtgggcgcctgtagtcccagctacttgggaggctgagacaggagaatcgcttgaacccaggaggcagaggttgcagtgagccgagattgtgccactgtactccaacctgggtgacagagggagaatcgtctcaaaaaaaaaaaaaaaaaaaaaaaaaaaaaaaaaaaaattagagatcttctgagagaataacgaagtcacattttagtttaaaaaataatggttttgcgccaggcgcagtggctcacgcctgtaatcccagcactttgggaggctgaggtgggtggatcacctgaggttgggagttcaagaccagcctgaccaacatggagaaaccccgtctctactaaaaatacaaaattagctgggcgtggtggtgcatgcctgtaatcccagctactcgggaggctgaggcaggagaatcacttgaacccgggaggaggaggctgcggtgggctgagatcgcaccattgctctccaggctgggcaacaagaacgaaactctatctcaaaaaaaaaaaaaaaaaaaaaaaagttttgaaatttcacagctgggcacagtggctcacacctgtaattccaggactttgaaaggccaaggcaggaggatcccttcagcccaaggagttcgagaccagcctgagcaatacagtgagaccctgtctctacaaaaaataaaacataagccaggatggtagtgcatgcctgtagtcccagctacgaggcaactcggcaggctgaagtgggaggactgcttgagccaggaggttgaggctgcagtgaaccatcgtggcaccactgctctcaagcctgggtgacagggcaacaccctgtctctaaataaattttttttttttaaagaaatttcacaaaatgggccaggaattgaagatatcacttactttttcagtaataaaaattaaaacaggatgtctgaatactacgaaaaactttgtccatctacaaaaaaagaaaaaagaaaaattataggatgcaaaaatcaccagctgggagacacatatcaatcaaaatttaatcaaagttttcattaaatattttttagaaccagaaagacatcagagaacacttaattgggcgttttgaaacatataccacaagcaatacgcatttgtcaaatgcagctctggattaaatgcaggttattgaactccccagatgataatgtgaattttaaagttctaagaggggagatgcagtgcttcccaaacttaaattgactcccctacctcattttcttcagagttacttttgggactcgtgttctgaggaaaacattaagatctcaatatagaggaagctgaggcatagagaagttactggctgcacagtttgtggcaaagcagcaactagaactcaaatcctccaaggatttccctcacaacagttgctcacaccttagagggattcatcaggtcagtctaatatataactggttattggccacgttgtaagtaccagtcttcactctgacttttagaaaattagtttctaccaggtggacctggagaaaacaagtaaaatgaacaggaaatgtgatgaaataaagagtatcagaaagatgtggaatcatgaagtgtccttctatcccttgatgagtcatttttccagttttatttcagaatctgggaaagcagaggtcttaatgcatcatgatttcactaacacgatgcacttttagccaggggacaaggatgggagcttggtagtcagggcaatatgagaggaacaaaaagattttggtcttttgggataacacatttcatcctcaaataactaagtatccagttctgtcaagacttcatatgactctatggtttcttcaatcttcatgcccagaggctttttaggatgttgttttagtcagtgttttgtaagtgatttttaattaggttactttcattatgtttataaccaaaatacttttgaacaaggcaaaaaaatgttcagtgcatttttattttgataaatttacttacaagtactggaacttacttaatcacttcttcatcagagataacagtttcaattttctgctgggggtctgcaagcaaggcctctaaaccacgaacagcaccttccttgaagagcaccaagggttctgtcccttgcactgaaagtatcctatatacttctgctgacaactggaagaacataaaaaattttaatttttattctaaaacaatttatacctaatataaggatatttagagaaggcttctttttaagtgactgctttattttcattttgaattaattttgctttataattatgtatggttccaaaatctaacctacaacacaaaacacatttagaagtcttaactttttctcttatcctctctacctagtccctgctttaatctgtaaattcatttttggtttacccgttgtgactactagaggttaggctaaaacctgggtttcttaaaactgggaaagatacagataagccattcatgcagaggtacatgcaattctggtgttagataaaaactaatgccacaattgtaactacagcctgcaattccagaaaaagaagttaacaccgtgtgtgaggaaaacaacaaaaaaacccccactgtttaaaattcaggattgtgttatgaatttcaaggtaaatgaaaagaatggagccagggaacagcacagctagctagctagaagtttcaaggatccaggcaacaactgcattatatctgaattaaccctattgtgagccacttctaaaatgtgccaattatatttagacatttagaactggaaagaactttcaagattaacctagtttaagatcctcattttataagtaagaaaaaatgaacacactctaggtcatcagtagaacatgcacagctagtcatgtttttattttattttttactgtattatgtgccactcttcaaaatgtacaatacatgggccaggcgcagtggctcatgcctgtaatcccagcactttgggaggctgaggtgggtggatcatctgaggtcaggagttcaagaccagcctggccaacatggtgaaaccctgtctctattaaaaatacaaaattagctggacatggtggtgcatgcctgtaatcccagctactcgggaggctgaggcaggagaatcgcttgaacccaggaggcggaggttgcagtgagtcgagatcgagccattccactccagcctgggggacaagagcgaaactccgtctcaaaaaaaaaaaaaaaaaagtacaatacaccaatacacgaaacttgcagggtctattctacctattctaagaaagggcacagaagttcattttgctctcacaaaagacacactccaaacatccaaactcatggaaataagtataaatttctcattcatcaattatataaatcctcatctccttaactcatggagacatgttaccaagatacattgtaagataattagaatgaaaacctgattaggaccttatgcttattttcccagaggtattaaaataaataacacatactttattatgaatgattctaattcaccaataagctaaacaaatatgttggaaaattcaaagacttactgtagctttaaatactttatccaggtttacatcttcattattccatattcttaaaaccttaaatcaaaacatactagttaaaaactatcctattctccatttacatataataaatacaaatagttaataatcaacatttatattgtatatattatacaaaagttttaaaactcaccttattatcgtgtacaacaacatactctccagtttgaaagttgcacacagctggacatgttataatttgaccttgtttcactgaccagctccccaagggtttctgatcagaaacctaatgaaattaagataaatacaatattcaagaagtcaacttcaaacattaaaagcaattaagtttataatcaataaaagaaaccattaaaatgacagcatttaaaaaatttactggccgagggcagtggctcacgcctgtaatcccagcattttgagaggtcaaggtgggcaaatcacgaggtcaggagttcgagaccagcttgaccaacatggtgaaaccctgtctctactaaaaacacaaaaattagccgggcgtggtggcgtgcgcctgtaaccccaattactcaggaggctgaggcagcagaatcgctttaactcgggaggtggaggttgcagtgggccgagatcgtgccactgcgctccacccacctcggcctcccaaacctctggaattacaagcgcacctcaccacgttcggctaatttttgtatttttagcagagacaggatttcaccatgttggccaggctggtctcgaactcctgacctcaagtgatccacccacctgggcctcccgaagttctgggattacaggcgtgaaccaccgcgtccggccaaacctctaaaagggtagttaaaatgaaaatataactaagttcctaaataagtaaataagcaaccctttgttaaaaaaacaatagtacatttaaaaattgattatattatgcctctgcatgggaagttatgcctctgaacagcggcatgggaaattaagtagggacatctgggatcatgtctatccaattccaatctgccattgtattcctatgcaggagctgcaaaactgcaaatctacttgacatcccaagtgaaacccaatagagttagcagagtcaaaacggcacagggagctgttagcaacctgttctcaaaacgtcaaagcagatacctaacttctttaaaacatggaaaactatgttcagcagcccagagaaaagtaactgctttctatgcgaccaccaaaagcaaggttagaaagtgttctctatcaggctttaggctgaaatgggggcagggcttgcagattttcccaggactcaactccaggattcccagcgtgaatcagagatgccaacagacaactcacttggaggcaagattcttagcgagctatcaagaaagtccctcactctctaaaattgtccccgcccctacaaagagaggggtgtgaagtgtagacacggctaaaccactattcccactctgtcagtgtcatcctctcccgcccaaccaatctccgttccatcctcccgcgggcggctaagataataaagaccctaggagggaatcttagcaaggccaattccgcgagttccgaagcaaaagcacaggttttctttcttttccgagtctaacccacgtgcactcagacgctctgcccctgcaagtcggaaatatgcctttacaggaaggcaagcaagccagattccagacctcactcagcgtccccaacaggcccagccggctctctgctaagccttctccacgatctctttctgaagctgtgagaaacttgagctcgagctccgcgctcagaaaggggcgagaaggcagtcggggcgctcccaaacctattgccttcaccttatagaggatgactgtcctgccgctgtctgtcactagaaactggtctgttttgtcgctctgctccacgcctaggagtccttcaggcccggcgctcaggactaccgaagacaacgtgaattcttcctccagcgctgccattttg

SEQ ID NO: 9748 - DNA, 131 bp, Homo sapiens
ttttttttttttgagacggagtttcgctcttgttgcccaggctggagtgcaatggtgtgatcttggctcactgcgacctccacctcccaggttcaagcgatcctcctgcctcagccccctgagtagctggg

SEQ ID NO: 9749 - DNA, 1630 bp, Homo sapiens
ctctatatcatggagctattaggtggcagagtctggattcaaacccagttctaccagagtagaaagtcatgatctttccatgactgctttcattgtttcatctagcatttcttcataagcctaaaattatctattggaaaattagctgattcctacaggctttcatcaaaggcttactttgcaccttttttttttttattattttaactacttaggcccccaatatttttggaattttataatcatgaaagataagctcaggaatttcagatgataaaatagttctaaaatagtttgtattacatgataaatgcaatagaatgctaatccttgttctagaaaatttcaagatgttcacttaaaaaacctttcgagtcatttttaaaattgtagtcctgaccttcagtacgtgttaaacaggttttttcaaaatttaatgaggatgagttttcatatgatagtcattttacttcagagtattacaaaggattcaacaattttagtataaaatagcagaacttgttacatatgtatggtctattactagctcagtctaaattttgcacatctatggagtctaaaattcaattgggattacatccaactttttgtttaagtagcaaagtaaaaaaattaaaatgcctagtcttaaatgaaccatagtttgagactccattctcttctcagccactttctggcttcacaagagcaactgtagcttttggatattaggtgagatttggacatttccataaagcaaagcatgaatagaatgctggctgcctttcacctcatctcatccattaactgtgaaaggtgagagccagccttatttttctaaatatcatgatttcaatatgtagcaaatgatacaactgaaaaataatttttggtatctacattatgcttagagttaacatctaaactaaccaccatttcccactcaaatatttatttaagtccctggaaaactttaatcattattgttgacttgtttttactcattttcagatgtttcttttcatttgttatttactcattagaatattcacttagtgtaaggagagattgctgttcttggagatacgaagacttcaaggagtttacagatttgcttgggaaaattagagtatcataaatgaagcaaaactgctagatgaatgtgctggtttacatatagaatttgtttctttctagaccagtggttctcaaatgtgattcctgaaccactggcattagcacacctgggaactttttaaaaattcaaatttggcctggtgcatgtggctcacacttgtaatcttagcaccttgggaggcctaggagagaggacagcttgagcccaggagttcaagaccagcctggacaacaaagtggaacctcatctctacagaaaataaaaaaaaaaaaattgccatgtgttgtggtgcatgcctgtagtcctagctactcaggaggctgagatgggggaacacttgaatctaggaggttggggcagcagcaagctatatgatctgattgtgccacagcactccagcctatgtgacagagtaagagcctgtctcaaaaaaatatgcaaatttgaggttttatcctagacttactgaatcagagactctgggagtggagc

SEQ ID NO: 9750 - DNA, 221 bp, Homo sapiens
atcacgaggccaggagatcgagatcatcctggctaacacggtgaagccccgtctctactaaaaatacaaaaaattagcctggcgtggtggtgtgtgcctgtagtcccagctactcgggaggctgaggcaggagaatggcttgaaccaaggagacggagcttgcagtgagccgagatcgcgctactgcactccagcctgggcaacagagcgagactccatct

SEQ ID NO: 9751 - DNA, 1801 bp, Homo sapiens
gtttctttggccaagtgggagaagagaactgtgacgaggcattggggaaggccaggggctggcaccccgtcacagctgtgtgcatgggcaacgcatcttaggagagtcaatggagagtgagcatccacagttgactcccttaaaaccagctcaggccacacccaccccaagaagtctctgaggacatcttgagggatgcaggcccaatttaaaactcctgcctacagcaaggtgtctgtcttaatactaacacactgcattctatgggtctggtaaacatctgccatctccaccccatgggagcttcttaagggaaagcattgagcttccttctttcattcactccctcagtcgatcagctggtcagtcggtcagtcaccaataactttgttttttttaacaaatatgcctgagtacccactgtgtactgggcagatacagctgaacaatcctctaggaactcacaggtttataagagaaacaggaaaaagtggaggaagtggaaggaagccaaagcatccatcctttcactttcactgaccactgagtgggtctcgctgggtctcagtgaaaagaaagccgtttctactgctttaaccctttccaatgcatgtcccttcagacagagtaacccctgtgagctggtaatcaaacagaattttattcaagtgaaacaaacaatggagaaatatggagtaccccaaatttcctccctttaatttgcacattttgaagtgccgatattagtaagtagtttatttacatgaacatacaggaaatttaacctttaagagtttgtaaaatacggcttagtttaaatgcatttatttgtctaaaattcctggtagttaattgtacttttttttttggcaagttttcacttgaaatctcaaagtactttaaagtaagatggcattaaaaacagcaacaggaataagccgacgtgtcttaagggctcaccatgtttagacactaagtgccgttaacatgtatcactatttactccttgaactcgtcctatttgttattatatacacaccatatactgtattattattattgtctcagcttcaccgataaggaaccctagcttggtgagttcagaattgctggcaggttagggaggaatggacagtggaacccagccctggctgtgcccagaccccctctcctctgcaatactgtctgcctctgaggcgcatggagtccttctccagctcttcaaagcgttgcaggtccatgttgtcccaacagaatttaaaagtgcaggccagcatcacctgcaaagtcccaggttggaagagaacctcgtctatacttctacgggcagataaggtcagaagtacattttccagtcgccacgtaagctgcagctctctctagataaacccgtgtctggaatagaagaaaatgctccccacgtgctggtcttctctgtgaccttttaattctggggcccggggctcccttgttggtcagctcttccctccacaccatccatgtgctgaggcctcaagccaccactgctccagcctggacctcacccctaaacccagtcttgtgagtgcattttctacactcccactagggtgtttaaaggacttctcaaccttagtgtgtcccatagagggttcctgagcgccccccagagctctgcctctcccagtctttcccaccttagtgaagtcactccagatcacttcctgtcacctggaaaatgtggagggtcctcctggagtcctctgtttctctcgcaactcacactctgcacacaagccatggaatggatcaggatccagcc

SEQ ID NO: 9752 - DNA, 1801 bp, Homo sapiens; identical to SEQ ID NO: 9751

SEQ ID NO: 9753 - DNA, 1517 bp, Homo sapiens
aactttaaagatttaaagatactgaagaggttaaaaaaaaaaaaggccctcactgagcctatgtaaagtgatgaattgctccacaaagtgatgaattgctccgcaagcaacatgcagaaatattgcactttagtgttgtaactcacttacattcctagatgatgttcatgtaataatagttcatacatgttgaatgtcaaacacatgccaaatatctcacttgtattatttgtaacttttttcccacaatattttagggttatatagatggctttgagactcagagaggccaagaaaatattttgtgggtgaataactagtaaattggaaagctggagttcagacttttgtttacatgacttcaaaacccattctcttagtctgtacctcattggctctcagggatctttcttagacacctcattgtctatgctctgtgatagtttgaccagttgtgtttgataaaagagatagagatgtacaaatccaaatctgcaaatccttgaccatgtaccatcattcatgtaggttctattctgattcaggacctgcttggagccttctctccaactcatatggcattctcccatcctgacaatcttccctgagtcttctgcaagttgtagaattgctcctccccctctgctataaggcctgcatataaaattggctgaggaatgtgcttggctcttttcctaaagattataaaatgatcatgaccctgtgaggccttaatgccctacagagagaaggccctaaaaatctaaactcaaggaaaactgtgtttttcatagtccagactcatttgtattaaatagatcacaaccagataatccctgagaaatttattatatcaaagtttctcctttttgagttgatctaaaggctaggaagagccttgcacatacctttgaggatagattatgtgtatgtgtatggctaggaatttacgtgtattaattccttaaccatgtatgactgagctcccatgtgacaccaaactttctttttctgagccatttgttgtgagttctttgtgcttttttaaccttgtctcctatgttttcctacaaaccacgtctccactagccatactgaactcaatatttcttctttacatcattttaggcaagctgtacattactggaaagagatgatgggtaaatatactaggtgaaggcctaacatgtgatttagctggctatgggtttaaaagctcatcagaagtgaggttgctgcacacaaaaaaaggagaagcagcagtgaatattagcaaaatattctctaaaagctcttcttttctaatatgggtcctggggaccctgtccactcaaaggagggtcttcaaatttgggaaatatatgaattttagcagcatcacagattttattttactgttgttttgtttttagtaagtgaaatctgagtccacatgcccgaagaacttatatcatctatgtgaaatcatatcttggagaaaatgaataggattggggacagtggcagcaaatcttttc

SEQ ID NO: 9754 - DNA, 1517 bp, Homo sapiens; identical to SEQ ID NO: 9753

SEQ ID NO: 9755 - DNA, 1811 bp, Homo sapiens
ccttactgatgcattctcgaaaacctgttagggtcctaagcattctccagttagtattgggactttacccctcctgtaaagatgttatgccccaaaaatgaagtggagggccatatcctgagggaggggagggatctccagagttggaagagtgatgcctttttgtccgcacttatatgaatacaagaatgtcatttctgaagctccccgtatcctagcttctggaatagcttttgttaggcctgctagtctgaggagggatcctaaaattccggataagacagtcccccaccctgatggggctttgggcaaaaattatgtctttctaattggtgagcccgggtgcctaaagaaggttaacagagtcctggagtttatactagaaatgattcttacaggagaaactagaaaagcaccagagacagggagtggtttccagaagcgggactagcctcagagaagagaggcaagagaaagtttttctgacaagcattaggacccaggaggcaagggtcaggataggtaggatagatgggcgagtctcgcttgggcaacatgacttcgagagttctgctcatggccacagggtcaaccaacttgttgtcaggaccccggagctgaatggctttcctctctgtcgaccctcggctcagcccggaagtacaggaaaagcggaaagctggttccaggcaaaccaacactcccaactccgaagagtcaggggttgttagagagccctatcccggaaagcctgacacccgtgtctttagtccagcggctgtgctagtcagttttaactggccgctagtcacttttaactggccgacaggtgcctggtatttagccaccgaattctaagggaaaacaggacagaatagcaagtgaaaggggtcagatggtactcactgcttggcaatagcgtcagccccaagtgaggatggggaaggggttttacagtcctctataagcaggaattgtcccagtctgatgtggctgctgcgtagtgcccgctggcctccctcttgatcttcagggggtgtcttctgcccagctctcttcttgcttctgctaacttgctgatgcatgctgctggcgcaactgtccttgcgcatttggactgggcttgaagagggaggaagtattcattcccttaagctttcaggcttgggggagaatctttcacaacccaatgatactcttttaaagttactttaaaatgtgcaataaagttttgttgactgtagtcatgctgttgtgctatcaaatactagatcttatgcattctatttaactatatttttgtatacattaactgtctctcccctcactcccttctcagcctctggtaaccattatctagtctctctctccgtgagttcaattgttttaatttttagcttccacaaataagtgacaacaggcaaagtttgtcattctgtgtacctggcttattttacttaacataatgacctccagttctatccctgttgttgcaaatgatgggatctcattctttttttatggctgaatagtactccattgtgtatatgtaccatgttttctttatccattcatttgttgatggacatttaggttgcttccatatcttggctattgtgaacagtgctgcaggaaacatgagactgcagacctctttggtatactgatttcctttcttttgggtatatactatgagtgggattgctgagtcacgtggtagctctatttttagtttttggggatcctccaaactggtctccatagtgcttgtactaatttacattcccaccaatggtgtatgaggattccct

SEQ ID NO: 9756 - DNA, 372 bp, Homo sapiens
ctctccctacaacttgaaggggacataaccgatagcccaggggtttttgtggttctttggagatttctttgcttatttccttctgggcaggggagattagaggaggcttatcattaataggaagggtagctatagggaggataggatatgggggtaagctgagaggtcctcctatgggatgtaaattgcaaactttgcatagttgtgtattctccttcaatgaaaagaaagcttggacataaggtgtttcactccatttgccttccctcttacagaaaaggtcaagcttcaggatagtattgtaatttatacttccctcaggtggccatttttccccatcagagagagaatatgggggccaggccatagtgc

SEQ ID NO: 9757 - DNA, 813 bp, Homo sapiens
taaccccaagaagaagataagtaattctgtctgaaaactttttggctgctcttaaggtcgagataaacctccgcttatttgagatggctcactgcaatggcctcatgggtgaatgacagtcataggagaagaagagaaagctaagcatgcctcctgcagccaattcacagaggttacacaaagcaagcaggagccagtgtagactctgaggtatcaaagaacatatcaagaaaaatggaggagagtttagtcttcatgcttgggattaggggagaaactagaaaaagtcattctatgggcagcaggcatccttataagacagaaattaaaggcagggtgggagatggggacagtggagcaggaaggaaagcaggaacactgaccaagttcactggaccttacagagttaagtgttaccagttaccatgcacccaggtacattctctcccaccatgcaccacagttagataccaccagcaagcaccagaagccatggccagggcattctctgctaaaacataccattaaccaaaagaagaacacaatgcagctacattcatttcatttgtattctttgttattggtttaattaatagttttgtaaggtgggtaaaaagtaaaaaacacaccaaccttctcgcagctctgagggatgtagggggtttgatgcagaacacaatgaaatgaggaaaggagaaaaacaagggaaacacagagagagtaaaaaggccatatcaaggctttcaactgctacttgaacatctttattcgctctagttcatccttcctatctcagctggaaaagttagcaat

SEQ ID NO: 9758 - DNA, 813 bp, Homo sapiens; identical to SEQ ID NO: 9757

SEQ ID NO: 9759 - DNA, 1393 bp, Homo sapiens
ctgggctcaagcaatccccctgcctcagcctcctgagtagctgggactgtaagtgggcaccactacactcagctaatttttttaaatttatttttcgtagagggtgtcttgctttgttgtccaggcttgtctcaaactcctggcctcaagtgatcttcctgcctcagtgttccaaagtgctgggatttacaggcatgagccactacaccatgccaaagtcacacctcccctgtcccctgggatatggcccaggaaagcctgtcccctctggggcttctaattcttgtctgtgcagaacctagcgtgtgtgcagagggataagaattgaatgaggtgatgtctgtgaagtgcccagcatagtaactagcatacaacagactgttagtagttggtaccttatttgagcgttccagaatcactacattgttccctgccattatttaaaataaaaaattcaccttttaaattgtgggagctctgctttagttacatatgaagctggcttttcagcagttgccattctgtaccgacatttgctttatatatatatattgtttgtttgtttgttttttgagacagagtctctctctgtcgcccaggctggagtgcagtggcgcgatctcagctcactgcaacctccacctccctggttcaagcaattctcttgcctcagcctcccgagtagctgggattacaggtgcgtgccactatgcccagctaatttttgtattttttagtagagatggggttttgccatgttggtcaggctggtcttgaactcctgatctcaggtgatctgccaacctcggcctcctagagccacatttgctttaaagaccccccgctttgcacaactataaatgagtgagtgtcacctctttttggactagtctccccaggaattcccagctgacttttttcatttgttttgttttgtttagttttgaaacagagtctctgttgcccaggctggagtgcagtggtgcgatcataggtcactgcagcctcgacctcctgggcttaagtgatcctcccaccttggcctcccgattagctgggactacaggtgtgtgccaccacacctggcctttttttttttttaagagatgtagggctgggtgcagtggctcactcctgtaatcctagcactttgggaggctgaggcaggcggatcatgaggtcaggagtttgagactagcatggccaatgtggtgaaatcccatctgtactaaaaatttgaaaattaggcacagtggcttacgcttgtaatcccaacactttgggaggcagaggtgggtggatcatgaggtcaggagtgtgagaccagcctgaccaacatggtgaaaccccgtctctactaaaaatacaaaaattagctgggcgtggtggtggg

SEQ ID NO: 9760 - DNA, 1392 bp, Homo sapiens
ctgggctcaagcaatccccctgcctcagcctcctgagtagctgggactgtaagtgggcaccactacactcagctaatttttttaaatttatttttcgtagagggtgtcttgctttgttgtccaggcttgtctcaaactcctggcctcaagtgatcttcctgcctcagtgttccaaagtgctgggatttacaggcatgagccactacaccatgccaaagtcacacctcccctgtcccctgggatatggcccaggaaagcctgtcccctctggggcttctaattcttgtctgtgcagaacctagcgtgtgtgcagagggataagaattgaatgaggtgatgtctgtgaagtgcccagcatagtaactagcatacaacagactgttagtagttggtaccttatttgagcgttccagaatcactacattgttccctgccattatttaaaataaaaaattcaccttttaaattgtgggagctctgctttagttacatatgaagctggcttttcagcagttgccattctgtaccgacatttgctttatatatatatattgtttgtttgtttgttttttgagacagagtctctctctgttgcccaggctggagtgcagtggcgcgatctcagctcactgcaacctccacctccctggttcaagcaattctcttgcctcagcctcccgagtagctgggattacaggtgcgtgccactatgcccagctaatttttgtattttttagtagagatggggttttgccatgttggtcaggctggtcttgaactcctgatctcaggtgatctgccaacctcggcctcctagagccacatttgctttaaagaccccccgctttgcacaactataaatgagtgagtgtcacctctttttggactagtctccccaggaattcccagctgacttttttcatttgttttgttttgtttagttttgaaacagagtctctgttgcccaggctggagtgcagtggtgcgatcataggtcactgcagcctcgacctcctgggcttaagtgatcctcccaccttggcctcccgattagctgggactacaggtgtgtgccaccacacctggcctttttttttttttaagagatgtagggctgggtgcagtggctcactcctgtaatcctagcactttgggaggctgaggcaggcggatcattaggtcaggagtttgagactagcatggccaatgtggtgaaatcccatctgtactaaaaatttgaaaattaggcacagtgcttacgcttgtaatcccaacactttgggaggcagaggtgggtggatcatgaggtcaggagtgtgagaccagcctgaccaacatggtgaaaccccgtctcttctaaaaatacaaaaattagctgggcgtggtggtggg

SEQ ID NO: 9761 - DNA, 124 bp, Homo sapiens
gcggatcatctgaggtcaggagttcaagaccagcctgaccaacatagagaaaccccgtctctactaaaaatacaaaattagccaggcatggtggtgcatgcctgtaatcccagctactcaggag

SEQ ID NO: 9762 - DNA, 448 bp, Homo sapiens
cagcatcctatcttgagtcctccctcatatccatcctctaccttgcgctgctcaccaggaagaccacagcagcctcctcactggccttctctgttccagactcatgctccataccagcaccagtgtgcttatgtgatcacataagtatttatgcgatgagtctttatcgtcgggtaccagcaagagaatgtatgtaagtggataaaaatgtaattcaacatgtgttttatgaattctggaaacctctttttattctcagaacatcaattcaaagtccatctcctgttgaaattcatcagtgggttaaactccgaattgtcttgatgctacaagcactacatcatgtgtgtgtagtttcattctaaagtctggttgcttcacttcttgttattaaatttaacaaacataactctccaacttggcgtttttgcagagtgggatcctttta

SEQ ID NO: 9763 - DNA, 448 bp, Homo sapiens
cagcatcctatcttgagtcctccctcatatcgatcctctaccttgcgctgctcaccaggaagaccacagcagcctcctcactggccttctctgttccagactcatgctccataccagcaccagtgtgcttatgtgatcacgtaagtatttatgcgatgagtctttatcgtcgggtaccagcaagagaatgtatgtaagtggataaaaatgtaattcaacatgtgttttatgaattctggaaacctctttttattctcagaacatcaattcaaagtccatctcctgttgaaattcatcagtgggttaaactccgaattgtcttgatgctacaagcactacatcatgtgtgtgtagtttcattctaaagtctggttgcttcacttcttgttattaaatttaacaaacataactctccaacttggcgtttttgcagagtgggatcctttta

SEQ ID NO: 9764 - DNA, 124 bp, Homo sapiens; identical to SEQ ID NO: 9761

SEQ ID NO: 9765 - DNA, 904 bp, Homo sapiens
tggtgcctcaggaagtctttgtcggcaaatctgagtatgctggaaagataggagcacataagactggttggcttgtatttgggggagaccgattgtgtcagatatgtatgtggaacgtagctgtccttgccgagtctgacctgtatgaaatgcatatccatggctatattattttggatttatggaggaagcagagcatttctgacacttaaggttgtatgcgtgagggagaaggctttcacagcttaacttgtaccagagcagctgcatgggtgctgacagcttaacttgaaatctgtgggaggaaggatcctttttcactcattcaacaaatataaccattcaatgaatggtccatgccttgaggtgaggatcatcaaggtgtctctgtaaatagcctggatgcaatctgaggggagttgttttgacggtggtaggtattaagttgagggaggcagtgtggaattaaaaccagagaactgtttttgggtactggtaattgttaatatatgtgcctgtggatgttggaacttcttggctgggctgaaggaatcctttgaaagactgatttcggcagggcgcggtggctcacacctgtaatcccagcactttgggaggccgaggtgggcggatcacgaggtcaggagatcgaatcacgaggtcaggagatcgagactatcctggctaacaggatgaaaccccgtctctactaaaaatacaaaaaattagccgggcgtggtggcgggcgcctgtagtcccagctactcggggaggctgaggcaggagaatggcgtgaacccgggaggcagagcttgcagtgagctgagattgcgccactgcactccagcctgggccacagaggagactccatctccaaaaaaaaaaaaaaaaaaaaaaaaaagac

SEQ ID NO: 9766 - DNA, 904 bp, Homo sapiens; identical to SEQ ID NO: 9765

SEQ ID NO: 9767 - DNA, 904 bp, Homo sapiens; identical to SEQ ID NO: 9765

SEQ ID NO: 9768 - DNA, 102 bp, Homo sapiens
gccaacttagctgtattcttctggaaaatgggatgtttcttgataggctagattagtggttcttaaaagttttttggggtcacttatccttcagagaatcgg

SEQ ID NO: 9769 - DNA, 718 bp, Homo sapiens
tgatttcatgtagtaaggatcccgtctatgaactctatgaatatgaggtaagaatgcatgaactaagccaacttagctgtattcttctggaaaatgggatgtttcttgataggctagattagtggttcttaaaagttttttggggtcacttatccttcagagaatcggatgaaagacactgggccctcaagttagaagatgagcataagcgcaatcacatgatttatatatatgattttaggaacttaaactgtaatgaaatagagccaatttatatttagatctcatttgaaaacctttcattttcattgttcgggtgtgtggatgttagtatgagtttaaggtgaaggagtctatgttagtatttgaacatgttgacaggatccatatttttaatttattctttttatcgtctgcaaacatttctgcagtattagtaaatgactctgtatttggtaaaaagggaagctaatgtcgcacaagtatctatggctttgttctttgtcagtatctttttgttctcaaactctgagaagcgtctttttttcagttttggattgggcctgaggtgatttgaagctcctgtcttggagtttaacttagttataacaaacactgagttaatcctatgcaggagacacaaagataattaatatatggtctctgtgcttgaagagacgctaattttctgtggttgaagagatgctgtgaattgtgt

SEQ ID NO: 9770 - DNA, 179 bp, Homo sapiens
gccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacc

SEQ ID NO: 9771 - DNA, 177 bp, Homo sapiens
ccgccattttgggttcgctttgcgagggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacc

SEQ ID NO: 9772 - DNA, 718 bp, Homo sapiens; identical to SEQ ID NO: 9769

SEQ ID NO: 9773 - DNA, 30013 bp, Homo sapiens
gcgcgcggcggcgcagtaaacagtctccttccacaaaaccatggcgtcgctcaaatgtagcaccgtcgtctgcgtgatctgcttggagaagcccaaataccgctgtccagcctgccgcgtgccctagtgagcggggaggtcgcggggtccaggggcgcgggtgtccggccatggcgggagggcgggaggccgggaggccgggcgggagcgggcgggctgctggaggggccggggaccctcggggctgacgcggcctgtggcctctgttgttacagctgctcggtagtctgcttccggaagcacaaaggtgagccccgtccccgccagccctcgtaccactgcgcacggggcagcccccacgtccagcctccgtcttgggggcgtggacccttggcgtgcgcttcctttcccgcctcgggtctccgcgggttctgcaggaaccttgcttcctctgacttggtccctggtgtctctgtgtgtcggacagttccctctgttgtccctgcctgtaatcgctctcagggttttggtcagtagcctttcttctaccccgcttctccttctgcgtgttactcttttttgcttagaaatagtttccgattgcttttcccaccgaggtctaccctagcagtttcttcctcagtattctgatgtagcccctcaccatttggctgaaactgcgctaactttaacagtattttcactcgtgtaaataatgtcttgttagaaacaaagaggtaagtccatgtacaatacaaggagacgtccttgatttgttaagagaaaaaaagaaccaagtaagttctgtgtatgatgtgaacacacttttgtacagttaaaaagaagtgacctggccgggcgcggtggctcacgcctgtggtcccggcactttgagaggccaaggcgggtggatcacctgagcccaggagttcgagaccagcctggccaacatggtgaaactccgtctctactaaaaatacaaaaattaggcgggcgaggtgcgcgcctgtaatcccagctactcaggaggctgaggcaggagaatcgcttgaacccgggaggcggaggttgtagtgagccgaaatcgcaccactgcactccagcctgggctacagagccagactcagtctggaaaaaaaaagaaaaaaaaaagtttgatgtaggtggggcgcggtgggtcacgcctgtaatcccagcactttgggaggccgaggcgggcggatcatttgagctcaggagtttgagaccagcctgggcaacatagcgaaaccccgtctctataaacaaacaaagccaggcgtggtggcctgtgccagtggtcccagctactcaggaggcagaggtgggaagatcgcttgagcctgggaggaggaggttgcagtgagccaggatcgtaccactgcactccagcctgggagacagcaagactgtctcaaaaaaaaaaaaaaaaaagcttgatgtagattctttcagcttatttccactcttgtaccaatatatagaacttttttttttagcttttagaatctcagcaatgagactgtacccaacatcctcatttgagtttatatattgggcactttttaaaacctagtgcatacaggctgggcgcagtggctcatgcctgtaatcccagcactttgggatgccaaggtgggtggatcacctgaggtcaggagttcgagaccagcctggccaacattatgaaaccacatctctactaaaaatacaaaaataagctgggtgtggaggtgcgcgcctgtaatcccagctacttaggaggctgaggcaggataattgcttgaaccatggagacgcaggttgcagtgagccaagactgcaccactgcactccagcctgggcaacagagtgagactccatctaaaaaaaaattaaaaaaattaaaaataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgtttaaggatcaaattagggtaattagcatattcgccccaaataatcatttcttcatgttgggaacactcgcaatcctctcttgtagctatttgaaagtataaattgctgccaacatggtcacactaaggtactgtgtaacactagaacttattcctcccatctagctgtaattttgtatccattaagcaacttctccctagccccctacactctactcttcctagcctccagttaccactattctgctctctacttctgtgaaatcaacttgcttagcatccacatgttaacaagaacatcttatggtgcctggcttgtttcacttaacattatgttctttgggctcatccatgttcctgcaagtgacaggatttcatggttttttatggctaatatccagtgtatatatgtaccgcatttctttatccatctgttggtggatccttaggttcattccttatcttggctgttgtgactagcagtaaacgcaggagtgcaggtatctcttcggcagactgatttcatttcctttggatatatatacagtagtgggattgctggatcatatggtagttctattcgtagtttttttttaggaacctctatgctgttttccataatgactatactaatttacattcccaataacagtgcagtgtataagagttcccttttctccacatccttgccaacatgtttttttctttttgataatagccattcttactgtggtgagatgatacctcattgtggtcttgacttgcatgtccctaataattagtgatgttgaacattttttcatgtacttgttggccatttatatgtcttcttttgagaagtgtctgtttggctcatttgcccatttttttttttttttctttttgagacagagtcttgctcttgtcgcccgggctggagtacagtggcgcagtctctgcttactgcaacctccgcttccagggttcaggtgattctcctgcctcagcctccaaagtagctgggattacaggtgcctgctggctgatttttgtatttttagtagagacaaggtttcaccatgttggccaggctggtcttgagctcttgacctcaggtgatccacctgcctcggcctcccaaagggctgggattacaggggtgagccaccatgcccggcccatttgtccacttaatttttttttttttttttttttggctgttgagctccttgtgtattctagatattaatcctttgtcaagtgaatattttgcaaatattttctcccatcctgtgggttgtctcttcattctattgtttcctttgttgtacagaagcttttttgtgtaatagaattccatttgcctatttttgcttttcttgcctgtgtttttgagattttattcataaaatctttgcctagaccaatgtcctgaagcatttcccctgtgttttcttgtagtagtttcaggtcttacatttaggtctttaatccattttgatatttatatatggtgacagataaggatctagtttcattcttctgcatatggttattcttacagttatcctatttttccagtaccatttattgaagagtgcttttttccccagtatatgctcttggtgcctttgtgaaaagtcagttggctgtaaatgtgtgaatttatatctgggttctctattctgttccattgatctatgtgtctatttttatgctagtaccatgctgtttagatattatagctttgtagtatatttcgaggccaagtagtggtgatgcctccagctttgttctgtttgctcaggattgctttggctattgggggtcttttgtggttccatattaattttagaatttttttttgacatttctgtgaacaggatcattggtattttgatagggattgcattgactctagattactttgggtagtatggtcattttaatatttatttttcttattggtggatatttacattaattttgcctttgttgctgctataggcagtgttaaagtggtatttaataaataatttttatcagaaatttctaatagccacatctgttgtacacttttcatttgtcttttttatttttttgcaacaaagtcttgctctgtcacccaggctggagtgcagtggtgctcactatagccttgacttcctgggctcaggcagtcctcctacctcagcctcccaagtagttgggactgcaggcgtgtgccaccatgcctggcttatttatttttaattttaatttttgtggagatgaagtctcactgtattgcctgggctggtcttgaattcctgggctcaagtgatccttccaccttggcctcccaaagcgttgggattacagacgtgagctacccatgctcagcctgtcatctttcttgattcccatgaatatctgctgtgtttggctttttctttcttgatattctttggaggctgggaagataccgctctgtggtattctctcctccctttctcccttcgaagtcctaaccaggcctgaccctgttacagcttctgaggtcagatgagatagggtgcattcagggtggcttagctgtagactctcgttttcttttttttccttttttcgagacagggtcttgctcttttgcccaggatggagtgcagtggtgtgatcacagctcattgcacccttggcctcctgggcccaagtgatcctcccaccttagcctcctgagtaacggagacaaactttatctatttttcgtagagacagggtctcactgtattgtctaggctggtcttggactcctgggcttaagcagtcctcctgcctcaacctcccaaattgctgggattacaggcaggagccactgtgcccagcttctccttccttttgctagatctctctcttgaaatgtggtccttgacttttattcctaggtaggtgatctctctttcactttaaacttttttttttcttgctgacatccaactgtttagctccagcctctttttgagcaccttagacacaaatgtattttggggtcaggtacaacccagaaaattcacctctccttcagtccctcctgctgtgttccttacacatatagcatagccgtaaagttagacccggattccaaatctgcctctgctacttactagctgtggaccccaatggacaagtttattacaagaaaatttaatcctttcatctgtaagtggaattaacagtctccatgtcatgggggcttcgtaaaggttcattgagccactatgtatctcactgtgtacctggcacagtgctcggcacttagtcactggcagctgttgtaactgccacctacatgactagaacctttccgtagcatattgtcaaatctacattttaagtctctacaatctggtcctgcctttatgtcctcagaaccctttcctgtgacttcatgctctgttgatactgtcacccaggctggagtgcagtggcacaatcacagctcactgcagccttgacacactgggcttaagggatcctcctgcctcagcctcccaagtagctgagaccacatgtgtgtaccaccatgcctggatgattttttttattttctgtagagacatagtcttgctaggttgcccaggctggtctcaaactcctgggctcaagtgatcctcccaccttggcctccgaatgttaggattacaggcgtgagccagcacagctggccttctgttgactctgtaagttctttggtggttttgcccctagttttatcccatctggtatctggtttacagcagctatttcaaacacctcagttaattgtggtgagaattttgtaagattcggcagggtagggaggatggggacaggttcttggggtgcatgaatgagtcctgctttctcagcctgctggcggttttccttaatctctctcttgctttgatctctcacttcttccacattcctgggcacccacccacatcccttaccccagacacttgcttcctacctagatgctaccttggtagggaggtgcagccttgtcgctgaaatggaggtaatgtgggcctgggatttgtgtctttttcagaacagtgcaaccctgaaactcgtcctgttgagaaaaaaataagatcagctcttcctaccaaaaccgtaaagcctgtggaaaacaaaggtgggttggttgacttcaaacaaatctacaagggacttcacatagaataagtcgaaggaaaaggggagagtggggctggtcagggaatccagaacaatagcttcattgggaaggaacagcttccttagccttgagcatcaggagtggggccatgtcatcatgggtgatattgaggcaacagcctgaaagcagtattcaggagaagaaaaatgggcagaagacagagatgagaaaggccatggctgtggtttgggggtttgcggtgggccctgctggcaggagccttctctagcccatagctgctggtctccctccatgaatctggctgggactgtcagttcacctgaactcagcccaggcaggaggctttctttgtcctagatcatctcgctgctgctgggggttcagagctcacagcagtagtgggctgtcaacccatccgtccagccatctaaacgttctttaatacctcctgggtggcaagcaccatgccaggctctgaaagcagcccctctggtgccaccaaagaggtattgaacattcactccaaaggcatggcccatttttgccctttgagaaatttccaggttgggttcaggcaatgccagcagtttctgcccatgctgaaagcacaggagattctacttggctggtttttacagagcatccagttaattggcccatcacagggttggagccatgttgaggtggggatgggtattaagttattagacaaccggggtctaagcctaaagaccacaggaccacatatacagtaaggctgtgaacactagagtgcatttgttaaaatcaccaattctttcacttagcctccctcttctaaaaaaggagtgttagtatagtcacagactccggagaagaggatttttgtctgtacctgcttgaatacccctatcactatcacatgtgcgtgcacacatttttatcctgttcaagtagtggttaaaatctggtgcccaggcctcctttttagccatgagccattgactgttttgtattccttagatgatgatgactctatagctgattttctcaatagtgatgaggaagaagacagagtttctttgcagaatttaaagaatttaggtaagtctgtgctatgcttgtcaatcgttgagatacatttactgtgttgtaaggattgtgattttttaaaaagtttttaatttcttgaataagtatggcatgtagggctcttactatctagccacataatctgtaaacatacagggtttcacacctcccagcctgcccacaccattccttctgcctggaatcctgctggtcttgtgggttggcaaaattctgctcctccttcaagccttggttcaagttttcttcactcagctaagcttttcttgaccttttgtgtctctttcagaattaggcacttttttggtttcccatagcaacttggacttaatagtaataaatcactgttacatttcatggtaatttgtctctcacataccgatttgtacagcagggacctgtattcccagatccccagtgctcagctcacagtccagcccttaacacaaactggttatcacatgatttgatttagggggaaacaggtgttgccatttttgtagcactgcttattcagtccttacaacattctgttacatgtgcatggggtctgttaatttcattcttcccatttcacagaatcatgttaaaaggttatgttttgcacttagtctcatggtaatgattagttagactgagtttggagatgagctagtaataggtgtgaaaaattttacagactgtgaagtaccatgcaggtattattgttggttccctgctactggtgctgctgcatgccaaatggcatgcttagacatcattcagattatttcgtatagccgtcttcaccactggcaacttttatggctagaaagaaagaaaacatgccagcagcttaatgctactatttgctttgtgattgtgctgataaagcatttttttcttagctgaagtggcacgaagttacaatatttacaaagataccaagaactggtatctgttactgcatttaatgcggaaatagtttgatatgctggtcttacctttcattttatagaggtggggtctcgccatgttgcacaggctggtcttgaactcctgagctcaagcaatctgcccaccttgacctccccagttgctggtattacaggcatgagccaccacaccttgctgatagttttattacacttgaaatagctcttcacttttcagccatctccatgtgtttccacttgaactcagactggctttttttcttgttaatttttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaatactaaagttttgttcctttttaaaggaaataaccacaagatttttcccagcccaaattccagcgccaattttaggccaactttggctgttttcttccaaaagtgcttatgtggaattgggatccccagtgtagtgacagacagtcatgactgctgctgagtttgatctgtgaaggtagtgaaatgtggccctgatgtttcttaaccctgatttggtaactaccagccctgacaccatcagtgcttgatgtagcctggaaccccaggcccactgacgcactgggcacggggctctgggtcgaaggctggagccgtcactgttgttcatgtgcatttggagcactgtgggaatagtctggcagctgtgtgctgattaaatgtctttggcaaggcagggggcaggaaaaggccttgtggaaacaaaggcaccaaggatcaccccagcccagtgaaggcagaagaggtcacgtggatcagcctgtgtctttccagcagaatctgattaaagcctgtaatgctgtagggtgaaggttcagggcagatgtcagcataccgcagtggagactttctgcagtgaaactttatcgatccctagaggggagagagagatgcagctttagcactagttcctgggagtgccagggcctaacaaccccacagagcagacgctaaaaatgcaagaaggtatggacaagtactagtattgggggccacagcaggattaaaatagcattacatccactcagtgtgagacagatgaggaaaccctaggaggaggcgctccctaagaggaatgtctgtcacattcctatgactgcttaaagccagaagggcaaaacatttacccttctgtttagcaggcctgtgtgttttcatgggagacttcatccagattaaggcctatagttattcctctgaatggaaatttggtgtttccttctgccttgtcatttcacttactccttgctgtgactccatgcagtaggttgagtattagcccattttatagacaggctccgagaaaatgtgtcttagccaagatcatccagtgaatggggcagaaccaggatccagaccctggggttctacctcccagtgcaacatactttcacctttcctcggccactttaattctatgaggcctggcttactggggtgactcacaaagccctgagtgacaatgacttcctgagtgtgctggctgacttttccctggatgcttatataaaaacagctgggcacggtggctcacacctgtaatcccagcactttgggagggcaaggcaggcagaccacttgaggtcaggagtttgagaccagcctggccaatatggcgaaaccccgtctctattaaaaatacaaaaaaaaaaatatagccaggcatggtggcacatgccctgtagtcccagctattcgggaggctgaggcaggagaatcgcttaaacccactgcattccatcctgggcgacagagtgagactccgtctcaaaaaattaaataacatgaaaaaaaaaaaaaacccacagagaacttggaccactgaccctgcttgtcatttcgtcagccagaaaaggaaaaaaccaagcaatacaatttggggaaaacatggtgccaaatccagtgccatttgaggtaacaaactcctcacaacccaagttgtgatgtgggactaattagattatttgctctcaagtcttgggtagtttcttttttgctatgtctcgtgaatttttcctcttttctgtaattgacctattattaccctaaaccaaacttttttttttttttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagctaaactttcatcacctcctgctcctgactcatctaaagccttggttctcacagtgtggttcatggagcatcagaatcagctgggagcttgctagaaacgcagcattgcatttggaaatgggactagaagatttagagatgctgaaataattagaagcagtttttaaaaagataaagggctctggaagattcccagttataacaaaataaataatccaaacctgcagctgatggggacatgcagccctctggtttacccagtagggttagggatggatcttgtcccagcctcagtctcattcccgctgtgaacttgtaggctttgctcctgctgttctcaggaacaaagctgtcatggccatcacacacaacgtacctgaggcagcgctcggatggacgtgacaccagcctggtcttgtgctgtctggacagtgtagctactggggctgcccctggggagctggaggcaagcccagaccactaatttcctctgaaagctgcctacacccatagccgtattggccaggaccagtcccaggggccagaggcggattattgcctccaggagcctggtctgcagcggcgaggtgctcagggaacagggagcttgagagaagtgtttttcttccacaccatccagctctttagcagcaaggcaggccattctgatcttaaaaagcaaatatccctttatagctttagatttatctagccctcttagcagaaaatggaaatcaaaactatctttaacaaatcatcttaacaaggtgaactgaaggcacctggttgcaaacagctggctgccctgaaccaaactggttccatatgccacaagtctatacaccccaggcaactgtgcttaggccttacatatgctacttgaaaacaagataagagtccatcaagatataactgatatgccataaaacccagtcttctaaagtgtacatcccagagtttggtatattcccagagttgcttataccactcttcacctacataaccaccctgcagggtaggtgttactgtgcccactgcatacatgaggaatatgaggctcagagaggctaaacaacctgcccaaggccacctgcattgcagtggcagagccagcattcccactcgggtccatctggtccccaaaattgatccactgcccaccccgacttcttgggtcttacttactctccacttctgccatgcacgcttgatgactgtggcagctgcatgcagcctctggatgtgtttccgagttaaccaggaacgaatggctaagaggtttgcccagaaacaggaaagagataataaaggggccattagagctgtcagtgacctcgctgcagcagcaccacagttgctgtcaaagtttcaaatacgttttttttttttcaataaattgctacaaataaggttctaaaatcaatacataaggcaaaattggcttttaaacattccttacactgcccacacacttgaatacacctacacaacacagtgaaggggcactggggagaaggactggctgagggcccagcaatcacttcccgtctcaggctgggtccaggtcagcacccagggaatgggaggggtctggattgtctgtgcctttaaaaacttttttttttgttttgtttttaatcctcagttgaatttgttcgctttatgcatccctgatctcacatcaccatatacccaaacactgatacaattaatagatggtggtaatttttattcccttctctgcaatttcagcatattctttttctttttgtttttttttttttttttttttttttttttgagacagggtcttgcccaggctggagtgcagtggcacgaacagcttattgtagcctccgtaaggctgtagcttcaatctcccaggctcaagcaatcctcttgcctcagcctctggagtaactgggactacaggcatgtgccaccaggcacggttaattatgttttgttgttttttttttttttgagacagagtcttgctctgtcacccaggctggagtgtaatggtgcaatctcagctcactgcaacctctgcctcctgggttgaggtgattctcctgcctcagcctcctgagtagctaggattataggtgcatactaccacacttggctaatttttgtatttttagtagagaaagggttttgccatgttgcccggctggtatgaaattcctgggctcaagtgatcctcccacctcagcctcccaaaatgctgggattacaggagcgaactactgtgcccagcttccttatacaattttttaatgcctacacacacacaaacacaccttaaaaggagggcatcgcccttaatatgtagtttgacatctaggtatgaatatcattttggaagtggttctccattaaatttataatattcttcaaaaacacttagctgcatcatagggatggtccagtccatcatttggccatgatgtcaccactgttagatatttgggttctttccaacacttttccttttcaaaataagaccactatgaacatgttggttaatacatcttttcatctgatgaactccttttggtttttaccttctccttaaattcattccagccctagagcccagcaggtaatggtttgagttgtcataaagggaaaaaaagttggcctaaacagctgtcagggtctgagaaaggaattaaagacaacgcttagacaacgcttagcctccacttcttacagagcacctttgtttgtggagtgacttggtttccattgaactggagagacgttatgagtgagggggacagggaatttgaatcccagcacaccacagggacatctcttcaggctgggacacagcttcaggagatggggactcgacgagctatgtttcaaaggaaaccaacatcctgtggggtctgtgagcagtgctgacaggtgacctgcccacctacctgcctggatgagcatgacggcccgccactgccgctcctgctctcggtgccggtgtcgcctccagccaccctggatgcagcgggcacactgctccagcacccgggcacgcccacattccagaagctccagctgggagaaaaggcatccattgagggcagcctcttctccccctgccccctcctgctgaggagagcacacagcttgcctctgtaacctcctcatccccaaaccagctcaccatagagtcagtcatgaacaccttggtcctgccacagtgcatgggggctggcatggcctcagccgagtcaccagttatggctgctgcctgagttaggaccggcagagtgtggagaatgtcctggatgagaggttcaagcgtggcttcctcgctgtgtggacaccattctgggggagggagatggccccatcagtgcatggtcatctctacatgcctctgtggcctgaagaaactggctttggcctccctagcactctacaggtctctttcctgctgttcttggctctagccattttctccttgttcttcttttggaggaagccacaaacagcctctctgttgtccctcagggtgctagctgttccgtggagccttggaatacccacttgcgcctgtgtgtcctggggtgtcccacagcctctactgccatgagtccctttgggcaggctggcagagggtgcttgacacctggaagggtgactccttccaagcttggaatcccaggctgctcagccagcatttgtttccaaggcccaaacacacatcctgagggccaaatagggcagctataggccactccctcagccccgacccctcaactccccaccatgtatgggaaaagggagatccaatcccagcccttagtttgggaatcttctactgcaaataaaaagaataaattaaaaaataaatttaaaaaatcccagccctgcaaaggtcccgtgtcccactgcctgccctcccgcagctcgcagagctgactcctggagaggtaggatttacctgagggctctgaccaccttagatgcccagtgcctctctgaagacagaggctgccaaaggagacaccacagatgagaaacagcagcaaaatcaaccaggggccagaagggctatgggcaagagacacggaacaggacagcaaaccatggagagggagaagaaaggagaaagggtgaaaggaaagtgaaaactgcccaggaggggaggaaacaaagcaggattgccccaatggctgtgaggggcccagggtaaggctgggtgggaggggcagaggtgctgggctggggtcctgccgaggcggggccccccggcagcctgtccttggcctgttctccctctgcctgtgtctgggccctgtggctcccacagcctctcttttatctgcatgccgacaacccccatatgagggcctccagatccttcctttgagactaaagcctgcctaagtgccttgcagacttcttcactggacctgcaggacaagtcacccatgcccgggctcttcagcctccctgaacctcttttcctcttgcttttcctcacttcccaggctaagttaatttactcctttcctctccctctacatctagtcaagcccctaccaagactgaccagtttcttccaacaaatatttcccgactgtgcccacaattcttgtttctctctattggggcaactttgcagcctcaatcccacagccctccatggtgcccccagagtggtctccagaaagtgtgaggctgataagagtcatttgctccttcccctgcagtgcctgctcatctgcccagagaataaagtccagattccttgatggagccctacctgccactccagcctcacctgccccagttctctgcctcaatgaaccagcaacacagaactggctggagttcctcatacccacactgctgcctcaagcctctaggcctttgttcagattacatttatcatgtggaccacccatcacctggctaatccaatttattctcagatactacctcttccaggaagccttccccaattcacacctccctagcaccacccacagcatcctgctcatagctctgcttttccactttccatgctatttgtcttttttgaatctgtttcccccactgaaccaaaaccagggctgtgttttattcaccagtaagccccagcccctagccctaagacagggcacagggtagatgctcagtaaactgtggttgcacaaatgactaactcatgggtcccactcaccagggagccctttggcaggatatgggctgtcggggccagaggatgtgcaaggatgaagccttcttagtaacttgtatcgttctacaaagtttcggtgagagaccctggaggccaaagcaggcagaagtagagaattacttcatctgtgagccaggttaacggttcagggctcatcagaagttattctatttaatctgctcaacaacacagcacggtgctgccctccccgagtatccccactgaatgtgaatgtggttttgaagcgatttctaggatcacttagttggaaacccataaagactatttaaaatgggtctgctctccctgctgccttggtctaccaacacaaagcatctcttgtgttagcaggggatttgcgggctgcctccctccaaaggggctgacaggcctctccccaaacaattggaccagtcctatgacgcagacatgcttggccacatctcccctctgacctctctgaccccacagtctcctctgcctcccccagatctccctgctcctcatcaaggcaacacttctcagacagctgctggcacctgatatctgcacttcctcccaattgcttgtcagccctcctgagtctggcttctgtccccaacattgtaccagtgtggcttttgtcacagccatcagctgggtacaaaatagtgcacaataagtgaatggatgaacgaatgggtgctgctccctagttcccagttgacttctacagaccagcctctttctcttcatttccacatctcactctgggttgggcaggctcttgcccaatgagagtcctgagccccactctgtactggccctgcactgtgccgtgatcgagcccactcaccggatggggaagccagcagcactgatatggatggtctccacgaggccacaggcctccagctggctcaggacctgcaagggtggggagacagggcaggcacctgcagcatggggccagcaggccagaaatgccattctctcagcccttcttcttagaccctggccagtgccaagctgcaggctctcccaaggcttggctaatgggggtatctccttggggctgtgagaaatcgagggaccttgaaaacaaatctcccactagaaagggtcctggtggtcccaagtccccctcatccgatgcatggcttctgatacagctgaagcaagtgatgtcctggctccgtctcaccctgccctcagtgtagtctcactaccacacaacccagcccaggcaaatttccagtttggattgttttcactgtctgcaggcattagagggtggttcacagctgagaggcagggaagattatactatgaagattcttctgtgacctgaacccaggtctttaccacagagctgagttgtcctggctacaaaccggaaggccacatctaccaggccacaccttcagcagtgcccagcattcacccctcatccacatccctcagaacctggaatcccaagaaaagggcagctgctggctagagtgcttttgttagattagaaaaaaatgataccggctgagtgcagtggctgctcatgcctgtaatcccagcactttgggaggctgaggtgggcagatcacctgaggtcaggagtttgagaccagcctggctaacatggtgaaactccatctctactaaaaatacaaaaattagccaggtgtggtggtgcatacctgtaattccagctatttgggagactgaggcaggagaatcacttgaactcgggaggcggaagttgcagtgagctgagattgcaccactgcactccagcctgggtgacagagtgaggctcagtctcaaaaaaaaaaaaaaaaagaaaaaaatgatacctccagtgagaaatggctgcactgtgcggggactgtgtggtgatgtagactttcagctaatcacgagacacccattcctctgggcagtttcagtctctcatcagggtacatggctcaaaaaaacaagatgcactggaacttgcctccctggctaggctactatgcacagaccacacaaccatacatgcctgccctgccacagcaagggagatgggtcctctctcatgtcaggcctggccggagagaccacttctgtgcactccatttggaacagatgtcctgcccttcatctctccagggccttggccagatggggtttggtgcgaagcagctttggcccggtgttaattacctcctcttggagaaaggtctgcgcctggccctggctgttgggcttgatgcagcgaatgtagtggggcgtggtgctgtgtaggacctgcagaagctgctccagtgaggcctgcagatgagagaccatggggttaggcagggagaggggctgcccagggccatcaactgggctctggttagtaactacatcaaatgcctccagcgggcccttccatgatcctgagaccaagaatctcctgtgcagggatgactgctgcaggctctcaacgagcaggctcagagcacattcctctcccaacttcccatgctcctcacctctgtcttaagggacccttctaaacctgtgatcctccctgactgttctccctgaatccaatctcctcctctttcccctccccacttctccccagagcaatcttcttagaaaagaacaatctcaaaacttcttgccattcgtccagcaacaactgttatcactcagctcatcctgtgtgttggaggctgtgcacaggctgcctgctgccatgtcagagctcactccaatgggccacacatgttggatgaacaccctcgggggtgtgtttgaggctgggtaggaaggtgctaatcaaacctggttttccaggtgcctcctcgaggtggtggtgataaagctaaagtctgaaggatgagaaggactaaactaggaaaaggggcgtggaggatgggagtgaggtggagctgatggggcagtagtcaagagtatcccaggaaggtggggcggtacatgcaaggactgagaggtggtagaaagcagacgatgtgagagaagtgagtgagggtagggttagaacaggaagctagacagctggagatgagccaggtcaaagaagctcatgtagctgatcctcttcccatgagcaccccagtggcagggggtgagaggctgcatagtgcccccataggcccctagacttcccatcatattatacctgatagcctatttgtctactgtttctgtcttccacactgaagtataaactccaggggactgggaccacatctacttgacttgccactgctccccaacaaacagcaccgatcctggcaggtgctcaataaatatttgtgagaccgtggagtttgaaccaagcacctcccatcagcacatcagacccaccttgaacttggacaccacggtcaacacaggggccctgctctggccagggggttcctcctgggtcttctctttggggttagtaggaaacagccccatgagcagggggtcctgggattgctgcaggagcctggtcagctcaggtgggatagggtcctattgggaaatggcaagagcagcagtgagggcaggtggagcttctgctcagggccatccactgcccacccaagccgcagatgacggggcttccaggtaggacagggcctgagtccaagagaaggtccattggacaaccagagacctggagacccagtctaacatgggttatctccaggcaggtcatgcttgattagtggagacctcagacaggtgggcccaagatggtgattctggattctgggaggaggttcaggagagaaaggactcacgatgggaaactactatgtctgcatagcaaagacccagcatctcgtttctcgcaggccccacaggcatggcccagcccgtaccttgttcttctccaccaggcctgctgtgtggtaccgcacaggccccgcataatgcaccacaatgaagctgggctcccggctgagcttattgtggcccaggcaggggctgcctgccagggcagtctcaatgcgtgtctggagctgggctgcgctgctgggtcgattgaggcggcattcctgtgggatgggaacagggggtcagccaccaacatgagagtgtctcaccacaaccctcactgtccccaccctgtggaccccatgacagcagacatcacacaggcatcatagtgtccccaacagaaaaaatatagcaattagcagatctatttggcagactgggaggagagaggcacagagaggaaacaggataatcatcaaggccccagaaaacccaaaggccaactctggtgctcggctcattagctgacctccccacctcatttatgagggagcagatgctgatggggcttccctcaatgagatccaaacagggctggttgtcctggtagttgatgaatgaccactccaggccctcaactgcgtattcctcctaaagaacaaggtgggatgaggtgggagaaggcagctgtggtctgatgtcctgacgggccatccacggctggcctcggtaccacagcgtattccagaacagcatcaaagaaacaaaagtatatcaaaacattacattgtactccatatgtgcaattattatttgtcaattaaaaataaaataagaaggaacaaaaggcttctaatcagaacctggactggggctggaaggtcaggaagggattgaggatccaaaagaaggacctgcctcctgctcaccccatccctcacctgctgggcccttaggtagtgagccacaaaatgctgctgcagcttctcattggcgtagttgatgcacaactgttccagactgttgtcaggaaatgattcaaatccatacacatccagcaggcctgggaagatggcagagaacccatggggccactgcagggagcagatggggaataggggaccaaggaacccagggtggctgggcccctgccaatgccttatacttggcagcctgggcatcaggctgagtgagcatgacacctgtggtgggcagaacataccttccccaccctccacccaaggtggctcccatctctaccccattcccctgtagagctcagagcaagcaggaaacccaaatgaagtgtgaagacagcccagagcatcaggcccatttttgagtctgaattctctggttctgataggcacctcctatgaggaaaccaggtcccagggaacattttctgtgttaaatctagttcggagggcattagtctcactagccaatttggtgcctagaattccaccattccatgagcaaactgcacttgtacctttaagctttatttcctcctataactgactgtcccacctagttacaaccgtgttgacctccctcagtcatgtcccccaagtctttttttgttctcccccctgagatagggtcttgctctgttgaccaggctggagtgcagtggtgtgatcacagctcacagaagcttcaaactcttgggctaaagtgatcctcccacctcggtctcctgagtagctgggactacaggcatgtagcaccatgcctggctaatttctttgaaatggggtcttgctatattgcccaggctggtctccaactcctggcctccagtgatcctcccactttggcctcccaaaatgttgggattacaggtgtgagccacggtgccagcctccaaagtcccttctaatacagctattttccccaacccccactactctcccacaattagagctgggtctctggggaggtaaagggctctttcagacaaggcactgttgagcctgtctggagagttatggactgctcagatgtgggtgcaggagagcagagatctcaccctatgcagagatctcgctctatgctggcaggcagatgcaagaggagacaaaaaagggaaaggaactgcccagagtcacacagtggacccagggctcctgcctctccatccagggctttattgctctttttctggagtgctcccagcacagtgaggccttgctacctatgaaagtggtccacgagtcggtgtctgcacagatgctgctgttgatcactgataccagccagtcaaacaacctgttgggggaagagagtggactctggtaagagggtctggctgagtcaaaggggtggtaaaattgctccccccatcagggtgctacaccctggggggcccttgtattctgagcctgacaggtcaaagaccaaatcctctcctcttgcttccggcctatcacgtcttgacctactacagatgcaggctatgggcatgcatgttgccaggtacacacaaacctggcatgtccttatgggaagactgagcacaggacaagctcagctcctaggctggggagggaatcagtcgagctcagtcacatggctcgagacccagctagtgtcttgggaaggggcagatgggcctgggtgtggtttgtaaataactgagttcattgaacacccctgcaaaactctaccggtggagcccagagctcaaggccccaccataccccctgatgtagttctgcacaagtgggcccccagtcccgaggtcaacaatggcatcctccactctagaaccggccccagcccagagaagatgagactaccacacaagacgctgacacgtacagcactatacaggggtttcttcctcacattttttcttaaagtaattgctctgcaacttttttcccttcagtaaataaactggctctttttgcaacaggggctgtgcaaatgtcctgtggtcagaagctcactctatctgtgttcatcacactttatctgctcatcttggagtgacttgtaggcaaaggctttaaaagcctttgacctcaaattgtgacctgaaattagcttgaggcagtggtaactagtctcttgctgaaatggatttagtctggcctcagctgccctggaccattttcaactcggacgatctggttcccccagcagagcttctcaggctattggctctttgtggagtttatgaaagcaggggaccctctccccagaaaggtgcccaaggtctcatgtgcacatgcacacacatacactcattctggctcatctcagaggattctgggcccctgaagcccttacaaggcctgctgaagaatctcagaactcaaggtgagagatcatccttaaccacatggccagagggtggaggtacccacgtaatctaccagaaaaggccaggaccccaccttcaccactgtgctacatgctgtgggctgagcctctggctttaccacaatctatcaaactcctaggtgatgtacaaaggcacagggagacagagaggcccattcagccaaggatctgaagcaggaactgcgaaggctctagatcacctttggggcctgccttgccagcagacagctgagcaggttctcttcaccttgctgaggctaaagcagcctcctgaactttaataatgagctgaattctggccaggaatgtagcaactttcccactcagaaagaggccacagacgctgcttggtgaaacctgggagctgtgccctgatgtgtccaggggtttgaggagcagggagaggaaccagtctgtcttatctcccaccctgggcctgtgcctattgcctgatgttgtctggcccaaccccggacaggaagagcacttgtcggggtcctccccaacaaggggccagagtaactgctcaccgcgcatagatcagtttggccaggcagtctctacgggtgtcacactcggctcgggcgcagggcttccggaacacctgctgctgtctgcctgccctgatggttctaatctgcaccatctccagcagcacgtcctctgggagccccagcagcgaggctgccgtcctgacagagtctgggaggggcaaatcctctttaggcaaatcactctccatccagtcctcttcacgaggcactgtgaagtcatcacagcgggaccatgacttgcccaactggacagaagaaacctaagttctgatcagtgaagtgactcacccaaaggactccataaacagcagtcagaactcaaacccagcactttcatgtaccagtccatgctgccatgtatgggacaaatcactttacaaacctctgactcattttctcatctttaagatggggacgatactgtctgcctcaccagacagggtgaggagtaaatgatccagggccaggccctatggtgggtggcataagcaagggcatcagattccaattttcaccatccagccttccacccaaccccagcaatgctggctaccttcctgacagggcctgccccatcctacaccctgaccctcacacttggcatcatccatcggctggcagggctgggcttcatcctcggaggcagcaaactggatattgccaaggtgcagcagtccagctaggacctgggggaaagaaaaggatgggtgggagtaggagagggcgtgacgtgggcctactctgggaagggccgttctgctgagtacaatcacgacagcagaagggcagctcccaatcatggcccaagtgcccatctctgccagacacaattctatacaagttacatgcatcgcctcattgcaacttttcaacaacctgtaaggtatgtgctacgccactgcctatgatagagatgagactgaggacacgtgcttcctgaggggaaaggtgggatgagaacccaggctgacttcagatgtctcctggggcagcctgtgggcctccatgcccacccatcctctacatttctgccccctgctctctaggaatagactggtgactgggggcagggctgcttctgtgtgcctgctggaggcttgtctctgcttccttgagccctttcccactgtcaggcttctgagagcccagcctgctggaggcactgtgaccttggtctgtgtccgatgggtgcccctttgcctttgtactcaatgttccacaccgacaagccccctggggctatagacagaagctcccctcaccccaccaaggcccagcaacttcaaaaccctcagacccagctaggcatggtggcacacgcttgtaattccagcactctgggaggctgaggcaggtggatcacttgaagtcagaagtttaagaccagcctgaccaatatggtgaacctccatctctactaaaaataaacacacacacacacacacacacacacacacacacacacacacacaaaattagctgggtgtggtggcacatgcctgtaatcccagctactcggaggctgaggtaggagaatcacttgaacccgggaagaggaggttgcagtgagctgagattgtgccactgcactctagactgggcaactagagtaaaactccatctcaaaaaaaaaaaaaaaaaagaaaaaaccaccaccctcagacctgacacagggaccccacccaccattcctatatggtcccaggcagggtgcctccatgtgctactggtcttccggccacaacttgctccagaagactgccatgcccaccaggcagaagggctgtggcagagggtcatgcccacccccaaagcactcctgccccgactcccagtgttgtccacttatcctgggcttgtccccaggtactgtccttctgtcaagttcttacctggcagtgtctgagcagcccccatctggaggtgagggtcactttccactgcattgctacctccctgaagtggcctccctttctcgactgccaggccatcctatctatcccctcctgctgctctagagggtgaggaagatgagaggaggtagtcagctctgtcagcaaagacagaagggaggcccccctagtgtgactgagaggagcccagctcacctggggcagtctcatgttccagaggacgacggggcacgggttgggggaagacagagagggtaggaacttggaattactatgtctggtactctgtatcaccacttagtggtatctgaccttgggcacgtcactttacctctctggttttctcaggcataaagggaaataaacacacacagaggactgtttaaaaaactaagtgagcagagaagtgtgaacatgacttgtaagttttaatgtactagacaagcaaggcggtagcactagttctctcttctgatcatgcggtaccttgctctctgcccccatggatcacttactgcattctgtactctagcactgtgtatgcatcactcttccttatgccccgtccaccccaccacctggtctccagactcagcagaacagaggtgactgattccttggaggtagcccagaggggcccaaagtcctagatcctcagggaaagaccaactccaagtccagggaaaagctctatgcaaagggctgcccgtcatctctgccaaacttaagtggcgtggcttttcttctgaccttaaagatgttgttctgggtaggggtgtcaatgcccaaatggagcatggcctctctggtcacctcaaaacaatcctctgaaaaagaatccaagttcggggcagaggtcagcagcagcaagatgcgagggaggcaggctctgtacagagtgggtgggtgatgctgggtcagcgcaaggtgctggatggggctccccttaccttctaagctcctctctgggttgggcagccaggagaaggcagctccctcaggaaggtgccactggagcctctcgtcctcactggctcctttgcaaatctgtggagaagggtaggtgggaggctgggtagggggtctgagaaaagcccaggcctgcataggcaggcatggggttgggataagaggagagttggtagcaacatcacaaggctcagaggtcccttccgagagcccacggcaggtatgggggcaaaagatgccgtaaacatagccctggatgtctccaacctgatgcaaaagaaccttgctctagggaaacctgcagtctggtgaaaaaaggacaactcctgcccagggagtccgtcgtcttgacgtgggaggcatacccatcacctaaggatgctccgattttgagagaaagggagatatcctatccatgccttgggggactcccagtccgatggaaaaggcacaactctagggaagcccttgttctgttagcgacagatgccattctaggagagcccttaaaatgataagagtgacacggcttccaccctagagatacagtcccagcctcaaggaccttctggtctgatggaggaggtaaaacatactcccaggccacaactgtgctgggagccaaggcgcagtgtgaggcagaagtgttgcatgtaaagtctgcaggataaagtggtggctccatcaaaagctaggtgaaggaaccaggtatggagcattctggggagtggggggttgaaaaacacggacccatccctgtctcgcatctggggggctgtggccccatttggcacaaacctgatagaagatgtggaagttcctctcactggaagcctggcaggccactcgagttttctctaggaggtaggtctggactgcggctccagtcatttgctgagccctgggacacacacaggccagagcccgttagttgcccattcattccatagccatgtctggcaatctgggtgtgccagattgcctgctacctggcaactccccgccaagctcttccacttagccaatgggcactgaggggtggggaccactcagaatgtccttgggtgtcctggaatattcccctgcatctagctcaggtgggcagggccaaggcctctgcacatcactttgctctaccccaagacaggagtcgaagtctcagcctcaagctcagggatatggtccaaagaggtggcaatttagcttgaagtccctgaacaagagtaaaagccaggaggaacccaggcctgaataagcgcactgccccagggtctcccaaggggagaggagctatagttctccaggtgcaaagatcaccctcagagctcacacctgaggtaaagggcatgcaccaggaggagcagggtttttgcccataggggtggcccaggccagatactgccccagccactttcaacctccccagtcccatcctcccactagccagggcaacagcagctattacctgttcagctggagctggatgaacttcccaaagcgactgctgttgttattcctcagtgtacacgcattccctacagatcacacctatgtttatttcactcccctgggtttgcagagtcctcataagccaaggtggctgcaggtctctggaggtcatgttcccgtgctcaagtcacctaaaggcccctttgttggttttcatgtcataggggacaggactagaaaatgggccctcatgctttagcaagtgggattcaggggagttagaagaaattcctggcaagaaattggaatgagcaagcctaggcagtcagggacctttctttgaagggaaaggtcaaaaacaatcagctgtcactactgactttagacaggaaggcacatctgggttccagtgccaacacaaacactaatcaccttgtatcccttaacaagtacccttcattgaaccatcaggaaactggatagaaagacagaatttggacgagctaagccaccaggtcttctccagcacgactgttatgtgtgcctaggctggagcgaggaagaggactgaatgacatgacctctgttagaatgatgctaaggagtaccagggagaggttggggatctgaggcagtgaaggatacactcatcctccacccccacccaagagagggtctcaaagcactgtccctctccctggaaggtggaaaatcccagaggaaatgggactgagatactgtgcaaaggagcccaagctcaccaaaagcttccatgacagggttggagttcaggatcctctgttctatcctctctgcaatcttgtggctctcccaagatgcaggtgaggtggccaccacagcatagaacttcattaggcagcgagacgtccatgtctgtggcagaaacagccctgtgggagctgtatctatgctcccgcccacttctgagcctgcctgagagaacagtgcccaccagagctctcttctccaccagtgtgttgctgacaaaatgggtgaaggcagaattcaaccctggcctcaggcaaggcacttcctctacctctgtttgtaaaatgggagtagacatctgtttctctcagctctgtggcagacactgagctatcgaggctttctgtgtatgttttttttgcaaactctgcaaaggtgtgattatacaattgtttataaacaataaaaccaaagcatagaaatttaaaaatttattaaaaatcatgcatctactcaatgacagggctcccatttatacccaagcagtctaactttttttttccgagacggagtctcatcttgcctcccaggctggagtgcaatggcacaatctcaactctctgcaacctctgcctcctgagttcaagcgattctcctgcctcagcctcccaagtagctaggattacaggcgcacgccaccacgcctggctaattttttacatctttagtaaagacggggtttcaccatgttggtgagtctggtcttgagctcctgacctcgtaatctgcccaccttggcctcccaaagtgggattacaggtgtgagccaccgcacctggccccaagcagt

SEQ ID NO: 9774 - DNA, 30013 bp, Homo sapiens; identical to SEQ ID NO: 9773

SEQ ID NO: 9775 - DNA, 6844 bp, Homo sapiens
ggcctcgcatctcccagctaggaagggaggcgggaggccctggacccctccttctcccctggcgttcgatggttgaactgtgggtatgggggtccctgccacaggattctaaatctgaggtttgtgcccccgctcccacccctacagaaagaagactgagaagagcctgacctattacacaaacctgcaggtgaagacaggccagcggaccctcatcaaccccaagccctgtggccagttttgctgctgtgaagtgctgggctgtgagtgggtaagggtcccaccccccggctgggagcagaggcattggcatcggggtgccccagataccagcatggggccacgtcatcccaatgggatgtgtcttgtggcaggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgccgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgctggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacctctcaattcacaccagccacatttaaaatgctcagtagccgcatgcagcttgtgcagccttacttaggtccagtgtcagcctggggccgtgctggggagctgagctgtgtccatgggggccctggtgagcctccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctccaaaaaaaaaaaaacagaaaaagaaaaaataaatgccatgctggagccttgtttggcctgcttgggtgctcatgccatctctttgggtaggttctggcccccagactttagctggggagccacatctgagagaataattgttccctctgagctcttggggacctaagatttggtctttctgtagttgaaggtcagtgcagagaacttgcccccaggctagtctcttggtctgcctaaatctgaccttctgacccacctaagccacgagcactgggagacaagcctcgagacctgtatcccctctcccgctgcaggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaatgtgagtaactgttctgcaaggcccctcccaggatagctggtgagaagagggcttggtgggtggggaaggagtggggacaggagtggggtgtgtgcggggaactaaaccagtgggtcatgttgctcagctcacatccttgcttttaagccctgagcaggcatggccacatttattacaaagtccttatagtaatgccatacacacacacacacacacacacacacacacacacacacacattatatgtatatatacacacacatgcatacatatatattttaatagactatctaaatactgaatggtagggatcatttgagttgaatgtggtatattcaggttggtagactatcaagcatccattcaaaattgtatagattttgtggcacccatgcagggctcctgacagaagcagggatgtaccagtgaggcatgtctatcatggacactacggggaggggccaggaaggaaggaaaaaagcttcgttgattggggtggcaggatcacaaattatttcttttacattttggttgctaatgaccttgttataaaactattttggggccgggcacggtagctcacgcctgtaatcccagcattttgggaggccaaggtgggcggatcacctgaggtcaggagttcgagactagcctggccaacatggcacaaccccatctctactgaaaatacaaaaattagctgggcgtgttggtgggcgcttataatcccagatagtcaggaggctgaggcaggagaatcgcttgaaccgggaggtggaggttgcagtaagccgagattgcaccactgcactccagcctgggcgacaagagcgaaactccatctcaaaaaaaaaaaaaaaaacaaaaaaaaactattctgtataggtaatgaacgattttcaaaaatcttagatgaatcaatgagataacagccaaacactcactcaactggcatctactcaaaaagctattggtttctcatgattagctttgccaaaccatctccctagattatttttctttttaaatttcactttgcatttggttaatcattccctgggaaagcacacggggcaggtgggcctccttgtcttcactttgccattccctatctgatgaattctgaacctcagtttttcatccaagaactggagttaaaacacctgcactattatacagggcgtgaggctgttgtcatgataatcaatgagctgatgtgtggttgaagctcttatctgactccatagatagttttaaactacctaagtataaattcagcagctttgcttaagatttaaagcaggtattataaatatgcattcctttgccaatcttttaatagaaggacaggcctattcttttgaagatggatctgctgatgagagctcccctttgtctactttacatcaaccacacccttatttcattgttttgtgattccagtgttggtttctttaaagtaaaggaagaatttagatatttgccgagccattctgaatatagaaacttcctagatcgcatatcccttgatcttttatcgttaatttactctcatctaattaacagcgttttgtttttttttttagaaattgacttttattaagtctttccaaagtagccaacttagttttcaaagaaaatttctctctatttttatgttcatctaatcagtgacagtaataagtcaatcagctcatgtaatcccagtaacaaacagcaggattgtggacacacacagtggagccctgatatgctgcagctggacagtgggagctgagcaggcagggcacccccccccccgcccgccggccaggactccaggccttcagtgttcagtcttgccatggcatcagtcattggttttgtatagggagcagagaaggttatttaatctggttagtcaggtaagtggagtttactcgtatgtgaaattgctttctttgctgtgctgtgaggagctgtacaaatataaggtgctgttactgattattcagccaacatttatggactaccaactctgtacctggcacagttttggttctggggtcagagatgacaaactcctaccctgggagtccactgagcgaccataccaataggtcatggcctcagagccgcgtggcccacggcccctgtgactctctctgctgtggacctttctcctagaacccgatcatcagccagttcttccccaccctcctgctctggtccttctcggccctgctcccctccattgtctactactctacactgctggagtctcactggaccaagtgagtgcccgggagccccgaggccctgcccctaagaaggatatctctgaccgctcccttgtccacaccctaaccccccagctgctcaggcagtgggcacatggcaggggcctcactgggggcacatagagcatttgggggactgcgagtgctcacctttgacttcctgcaggtcgggggaaaaccagatcatgatgaccaaagtctacatattcttgatcttcatggtgctgatcctgccctccctgggtctcaccaggtatatgccaccaccttctgctctaaattcagaataagagtcacatcaggagagcactgtccccaggagaatgcaaacggtttggcagcagaagcaaacctctaacaatatctaagcctgtcgcaaccactcggcgtgcagtagggctgggtcattgattcttctggcaatatgattgattgttcttctttaaaaaagaaaaaaacaccatattggtcaggctgttcttgagctcctgacctcaggtgatccacccgcctcggcctcccaaagtgctgggattacaggcgtgagactctgtctcaaaaaaaaaaaaaaaaaaaaccagcttgaaaattttgtggccaggcacagtggctcacgcctgtaatcctagcattttgggaggccgaggtgggcagattgcttgagcccaggagttccagcctgggcagtctggcgaaaccccatctctacaaaagagaaaagaaaatgaaacttatcaaggaccttccacttagggaaggcctcatcatggctttatttatctcaaggaaggaagtttctgttaaagcagactgtgacaggtcatgccgtagtaagtggcatcgttgagaacaaaagtcaatctcgagctttggcctgtttttagagcaaaagaaaatgaaagcatgtgtagtgacaatatggaatgctggaaataaactcttagggggttcctttgtttttcagtctagattttttcttccggtggctctttgacaaaacttcctcggaggcctccatcaggttggagtgagtatt

SEQ ID NO: 9776 - DNA, 3530 bp, Homo sapiens
ggcctcgcatctcccagctaggaagggaggcgggaggccctggacccctccttctcccctggcgttcgatggttgaactgtgggtatgggggtccctgccacaggattctaaatctgaggtttgtgcccccgctcccacccctacagaaagaagactgagaagagcctgacctattacacaaacctgcaggtgaagacaggccagcggaccctcatcaaccccaagccctgtggccagttttgctgctgtgaagtgctgggctgtgagtgggtaagggtcccaccccccggctgggagcagaggcattggcatcggggtgccccagataccagcatggggccacgtcatcccaatgggatgtgtcttgtggcaggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgctgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgcttggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacctctcaattcacaccagccacatttaaaatgctcagtagccgcatgcagcttgtgcagccttacttaggtccagtgtcagcctggggccgtgctggggagctgagctgtgtccatgggggccctggtgagcctccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctccaaaaaaaaaaaaacagaaaaagaaaaaataaatgccatgctggagccttgtttggcctgcttgggtgctcatgccatctctttgggtaggttctggcccccagactttagctggggagccacatctgagagaataattgttccctctgagctcttggggacctaagatttggtctttctgtagttgaaggtcagtgcagagaacttgcccccaggctagtctcttggtctgcctaaatctgaccttctgacccacctaagccacgagcactgggagacaagcctcgagacctgtatcccctctcccgctgcaggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaat

SEQ ID NO: 9777 - DNA, 5025 bp, Homo sapiens
gaaagggctcactgtggtagaccagaaccccaggagtcatgccccacttcagatgtaagatggtctcagggtgactctgaacatttctatctgattaaagatctggagcaaacctaggctaaaactggggccccaatatcaatgtctggttctatttaaatagggaaaaaagccccccaagatttacagaatcaggggctatcagagagtcttttatactttcctgccctcacccaaattaggaggtcacaattaatggacccagaagatatccatgatacttaattaaaatcagggtgtggcattatatctaagggcaactgcaagaatccaccttccaaaatgccaccatgaatccacttaggatacccagtggttcccaacgttggttttgtaacaacataggatgtttttagttttctcaaaacaaaatgaattcacattatgcctttacctgcaatggaaggttgagaagttatcagggagcattttggtttcaagcagaggccttgatggtgtagctctggaaagaccagtcagacgttgtcttcctgctggtccagacatgctcctcctccccagagctccacaaaccaaggctgattggttacgccccctcctgcttccccacatgaccctggaactaagtatctgtgcttctctgcagacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgtgttgttgagctgtgggcatgaacatgccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctggtgagtgaggcgggacttagggacatgtgctgggagggactcaggtgggagtcggagtggaagggcctcccaggctctgccacaggccctgactgcaatgagctctgggagggcctcaggagccccgcttgcttattcttgctcacacttggcaccatctttaaaaaaaacagtttcctggtggattgtttcaagatttggacagttactggtgctaagtaaagaaatttgggttgagagcagccctttctctttgccgcccacagcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcctatttttttagagacagggtcttgctctgttgcccaggctagagttcagtagtgcaataatagcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctggtttttttttttttttttttttttttgagacggagtctcactctgttgcccaggctggagtgcagtggggcaatcttgctcactgcaacctctgcctcccaggttcaagtgattctcgtgccccagcctcccaagtagctggattacaggtgtgtgccaccacacctggctaatttttgtatttttagtagagacagcgtttcaccacattggccaggctggtcgcaaactcctgacctcaagtgatccacccggctcagcctcccgaagtgctgggattacaggcatgagccaccgcacctggccttgctggttgttaatatgtgtgtagatattttctggtctgagggtcctttgctttcattagaccctctgaaaggtctgtgaccttaaaaaaggctacctgaataggatttcagtgatggctcaaggtagatactgacctagcacaaacaataaatctgttcctttgggtctttagaggggatagtgatgtgttcatttttccccaggagaagtgccagctgattccaagccaagtgggtataaacttgtcagttccaggcagttagcttcatactactaaaaaaggctagcggggtgcagtgactcacgcctacaatcccagcactttgggagggtgagacaggaggagtgcttgaggccagaagttcgaaatcagcctgggcaacatagcgagaccccgtctctacaaaaaataaaaatcagcctggtggcatgtgcctgtagccccagctactcaggaggctgaggtgggaggattgattgagcccagaaggttgaggctgcagtgagccatgattgcgccactgtacagcagcctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaa

SEQ ID NO: 9778 - DNA, 1006 bp, Homo sapiens
gcaggagaatcgcttgaaccgggaggtggaggttgcagtaagccgagattgcaccactgcactccagcctgggcgacaagagcgaaactccatctcaaaaaaaaaaaaaaaaaaaaaaaacaaactattctgtataggtaatgaacgattttcaaaaatcttagatgaatcaatgagataacagccaaacactcactcaactggcatctactcaaaaagctattggtttctcatgattagctttgccaaaccatctccctagattatttttctttttaaatttcactttgcatttggttaatcattccctgggaaagcacacggggcaggtgggcctccttgtcttcactttgccattccctatctgatgaattctgaacctcagtttttcatccaagaactggagttaaaacacctgcactattatacagggcgtgaggctgttgtcatgataatcaatgagctgatgtgtggttgaagctcttatctgactccatagatagttttaaactacctaagtataaattcagcagctttgcttaagatttaaagcaggtattataaatatgcattcctttgccaatcttttaatagaaggacaggcctattcttttgaagatggatctgctgatgagagctcccctttgtctactttacatcaaccacacccttatttcattgttttgtgattccagtgttggtttctttaaagtaaaggaagaatttagatatttgccgagccattctgaatatagaaacttcctagatcgcatatcccttgatcttttatcgttaatttactctcatctaattaacagcgttttgtttttttttttagaaattgacttttattaagtctttccaaagtagccaacttagttttcaaagaaaatttctctctatttttatgttcatctaatcagtgacagtaataagtcaatcagctcatgtaatcccagtaacaaacagcaggattgtggacacacacagtggagccctgatatgc

SEQ ID NO: 9779 - DNA, 5027 bp, Homo sapiens
gaaagggctcactgtggtagaccagaaccccaggagtcatgccccacttcagatgtaagatggtctcagggtgactctgaacatttctatctgattaaagatctggagcaaacctaggctaaaactggggccccaatatcaatgtctggttctatttaaatagggaaaaaagccccccaagatttacagaatcaggggctatcagagagtcttttatactttcctgccctcacccaaattaggaggtcacaattaatggacccagaagatatccatgatacttaattaaaatcagggtgtggcattatatctaagggcaactgcaagaatccaccttccaaaatgccaccatgaatccacttaggatacccagtggttcccaacgttggttttgtaacaacataggatgtttttagttttctcaaaacaaaatgaattcacattatgcctttacctgcaatggaaggttgagaagttatcagggagcattttggtttcaagcagaggccttgatggtgtagctctggaaagaccagtcagacgttgtcttcctgctggtccagacatgctcctcctccccagagctccacaaaccaaggctgattggttacgccccctcctgcttccccacatgaccctggaactaagtatctgtgcttctctgcagacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgagttgttgagctgtgggcatgaacacgccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctggtgagtgaggcgggacttagggacatgtgctgggagggactcaggtgggagtcggagtggaagggcctcccaggctctgccacaggccctgactgcaatgagctctgggagggcctcaggagccccgcttgcttattcttgctcacacttggcaccatctttaaaaaaaacagtttcctggtggattgtttcaagatttggacagttactggtgctaagtaaagaaatttgggttgagagcagccctttctctttgccgcccacagcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcttatttttttagagacagggtcttgctctgttgcccaggctagagttcagtagtgcaataatagcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctgggttttttttttttttttttttttttttgagacggagtctcactctgttgcccaggctggagtgcagtggggcaatcttgctcactgcaacctctgcctcccaggttcaagtgattctcgtgccccagcctcccaagtagctggattacaggtgtgtgccaccacacctggctaatttttgtatttttagtagagacagcgtttcaccacattggccaggctggtcgcaaactcctgacctcaagtgatccacccggctcagcctcccgaagtgctgggattacaggcatgagccaccgcacctggccttgctggttgttaatatgtgtgtagatattttctggtctgagggtcctttgctttcattagaccctctgaaaggtctgtgaccttaaaaaaggctacctgaataggatttcagtgatggctcaaggtagatactgacctagcacaaacaataaatctgttcctttgggtctttagaggggatagtgatgtgttcatttttccccaggagaagtgccagctgattccaagccaagtgggtataaacttgtcagttccaggcagttagcttcatactactaaaaaaggctagcggggtgcagtgactcacgcctacaatcccagcactttgggagggtgagacaggaggagtgcttgaggccagaagttcgaaatcagcctgggcaacatagcgagaccccgtctctacaaaaaataaaaatcagcctggtggcatgtgcctgtagccccagctactcaggaggctgaggtgggaggattgattgagcccagaaggttgaggctacagtgagccatgattgtgccactgtacagcagcctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaa

SEQ ID NO: 9780 - DNA, 1910 bp, Homo sapiens
ggggatggggcaaatctgagttttaatgaacactgccattgattctgatcatgctgaagtttagaaaccactggtttgatgcttatttgcactattatactgtggtttacatatgggcttgacaggtccatttactttcatttacttgctatttgagattttgtctggccagacaactgagcctcagataaattattttcttactaaattctggtaaataccaataaaaccttgaatacaaccaacataggacagtcagttctgctataatgatttttaaaatgggaatttgtttcaatgcaattaatatattgggaaacaaatttagcataaggcaaattttgcatttatttgtgcactacttcatctgctagaccaactaggtgaatgtaggaaccatacacagctgagctgagtctcataggaacacataaaacacacacacacctctcaaggacaatcagtggcccagacccatgcacatctactattacaacttcttgtccatttccaccacttcactgttattaatacaagctgcaagtcttccacaaactaacttcaggtggttttcaagataaagtgccatattgcttgcagtatttatgtattttttaatcatttaatgaatgtaaaactatgctaccatttattagctgcttctttttaaaaatgttccactgacaaatgttttgagtattatgccccgaggcctatgatttttattgtgttcttttgcattgcacagagaattttagcaatccctatgttgcactaaagcagaattgagactaatttgagcaaaacttagcaacttataactgttacaatccttatttcagggcaaacttttcattttataatcataattattttgtttcctcttgagtagcacacacacacacacacacaaatctaaggtgttcactatcacagaataatagcctttaaaatgtttaccagttttcatattgatatattttgtttgactctgtcattccgggctttaagtactaaaatatattagtctttttcagaaaacattccaagaaaaaagttgaattcctacctagtttcctctctctttgataacctattgtcatagtaatatacaaatacctgaaaattgcccagattattcttttcttcttggaacacagatttgttgataagtgccaaaggattttttacaaaaacatgagaagtttgacatcacagtaagatttaaaaggaaaggctgtttattgttattatcatcattgctactactatttccgttagtatatatttctttgtcttatttgtccttttccaaaagatttttgttcttatatttttaattagctctttaaagaaatcaagaactgcttgttgattatagacatccttattgtataaagagggagaagttctttggtaattagctgtgtataggttctgttcaaacaattggctcaagtgaggttgtacagaaagaactcttgtattttcttatttttcagtatattctccactccatcacacctctttttccaaagatgcagtgcaaagaaagtataatctctggagtaattaaagctcagtgaggaaatgatatcacctgatggccctatgaagcattcagcaataaaaggtgagttgcccaaaatgcatttaccctgaacaggaatacaatgaaactaccaagttttatctttataatgattcgtggcttattattttgttgtttgtatatgttctgtttcccacatcagtgttgtcttacattattatctgtcttaacttagactctgttttctaaattgctctgtgcaattaaatgctttgtgatcataataaaaagcatcatgataacttttagactagaggtttccatacaaagctgtatcccatggagagcagctactggc

SEQ ID NO: 9781 - DNA, 1910 bp, Homo sapiens; identical to SEQ ID NO: 9780

SEQ ID NO: 9782 - DNA, 1910 bp, Homo sapiens; identical to SEQ ID NO: 9780

SEQ ID NO: 9783 - DNA, 1585 bp, Homo sapiens
aatatatgtgatttctcctttgacctgtaggttatttagaagtgcatttttagaaggatgagattttctaaaaatgttatttgggtgcataattttattctgttgtggtcagacaatagtccctgtgaaatttcagccttttgaaattcattaggaatcattttaaggaccagtatatggtctgaattggtgaaaattccatgagaatttgaaaagaaaaaagtgaaatctgcagtttttgagtataatatctataaatgtcaccaaagtcaagttggctgataatttgttctgggtatttctatccttcttggtttttaaaatcagggttgttctagcaattgctgagagagtactattcaattttctagacatgacagaaattttcaatctctcttatttttgtcagtttttgctttctataattttcaactttaattaggcgcataacgtgtcattgtatctttcagatgggctgacctttttatcgtcatgaattttgaatttttttcctaattagcttcgggatgccagggtatatgatgggtcaagaacatgacgtttcaaatttttcagtaatcataactctaaagtaatgtgtaactctgaaataatttattttatttaatcatcttttatcttattaatcaattgatttgttcccacaattacttacgtgtactttagaccattcctggattgacagtaaaagggagcacatgacaaattcttagttttagagcatgggctgcacaatcctgagcccagcctggtggtgatgaaattaagcccagtactaagagcgtaaatgaagaagaaactcagtagtaagagagtgtggaccaactggtcagatgctctaatcagcaactctcattccactgtcaaaaccttggagattttgtatgttttttaaataggtgaagtgaatcaagtggtgcctaccaaatttattttgtcctctgcatcagtgcgtggcatacaacattaacaatgagaagcaactaactcctataagctattttgggggaatagaggatggtacaaatatcacaactttacagcaaatattacaactccttcaaaacacagtttggcagtttttaaaaaaataaaaataaaagagttgatcaagctgggtacagtggcacacacctgtaatctcagcactttgggagactgaggtgggatgatcacttgagcccaggagtttgagactagagtgagctatgattgcgtcactgcactccagcctgggtgatagagtgagacccagtctctaagaagtaaaaatgaaagaaagaaaaaaagttggacaggcacctgccacatctcatttattccactccaggtatttaaccaaaataaataaaaatgtatgtccatagaaagatttacacatgaatgcccacagcaactttattcatagtactccaaactggtgacaacccaaatttccatcaacagatagataaactaatgatggtatatccatataataaatactgtttaataataataaataatgaactattgatgtatacagcatcttggataaatctcaaaataattatgatgactgaat

SEQ ID NO: 9784 - DNA, 102 bp, Homo sapiens
gcggaggttgcagtgagctgagatcgcgccactgcactccagcctggaccacagagcaagactccgtctcaaaaaaaaaaaaaaaaaaaaagaaagaaattt

SEQ ID NO: 9785 - DNA, 1317 bp, Homo sapiens
gtctcgctctgttgccagcctggagtgcagtgatgcgatctcggcttactgcaacctctgcttcctgggttcaagtgattctcctgtttcagcctcccaagtagctgggattacaggcgcctgccaccatgcccggctaatttttttttttgtatttttagtagagacggggtttcaccatgttggccaggctggtctcaaactcctgaccttgtgatctgtccacctcagcctccgaaagtgctgggattacaggcatgatccaccgtgtccggcctctataccaacaattctatattctactttgtgatactagagctgggactcgctagacttgtggctctcctgggatccctgagctccttgcaggagatttttaaggtcaaaataattttcataacggtattaagatattatttgcttttcttactcttattctcttttgaatgtacagtgaagttttcaagaggctatatgacatatgatccagtaacagaaacatagcaccagatgtaatttacccagctgtcttccatgaagccaggcattaaagagatttgcaattatgcaaaacaatgctacccttcttactattttttgtttgtttttgaaaatagttatttttcataataatgggttattttttgttaacaggtagtggtttgattcttgttatttttggaatgtcccatctttaatatggcaaatatcaatagatatcatccacataaacataagttccttcaggtcttcaatttttaagagttcacagagtcctgtgatcaaagagtgagaaacactgctgaagacatttcttcattgccagtggattcctgttctatccatagagggcgctagagagagacgagaaggcacaggggttggggcggtggggtggggagtcgcgggagaaggggctggacccagcaagagaacctgctgctcctgttgaatctctgcagcgtttcagcccggtggcggtacgatgttgtctctacctgcagactctaaagcagtgtaggctctagtctctagctcatgtccacaccaacaaaagcacaatgagctccctgctaagcaatctgggacaggccacggtgatgcaccctcctcagaggtctgagttcctgggctatagactagtcttgaattccccagttaccagaggcagccaggaagtatcacttccacaaaagtccaagggctaggtttgctaggcaacccctcacctcagaatttcatcctagctccaaggaatcctttcctcagggcttctaggtggtgattactgccatctaagggcagcacatgtttcct

SEQ ID NO: 9786 - DNA, 1237 bp, Homo sapiens
ccacaagtggcccctcctcctcccacatggctcctcgtcctcatcttcttacagtcctcttgctcctcccactgggactgaacccaaaggcatctcttcaatggggtggtccctgcctagggaaagccggtgcctccagccctttagtgccccttctgttatggcgtgtctcctgtgaagtctctgtcatccccaaggtcaagtttgctgggctcaatgattctgtgtgccctgcatcactttgctagcaggacagggattggcctccagtcttcagtccctcatccccaaagcccagaatagaacttcacagatggacctggggcccctcccggagccgggctttctggagtgttctcatttgctaacatctgcctccctcggcaacctttcctctgtaatggaacaggtccagaagagccatgtgggctgacacagtaaggcctccaggcatctgtgccgtgacgtgagcaaagtgtgagctgcatggtgggatatgccatgccttgcctaggggcccgggcactgccatcacagggaggtttggccaccaaccgacatggctgccccaggtgggaagggtcggatggaggaatttgccacccactcttgggaaacacccccaaaatgaacgaaggaatgacctctgtcctgttttagcatcccgggagacacactgtggcctaggatcctgcccggctgcagggctctggatggggcgtgacatcctgcccccgagggtgtggcggggagtcgatgtcacacagctgagccacagggcccagggatgtggtgaaagctttccccaggtcccaagtgcccacagcccctgccccatccaagacccagaaatgcagctcactctagcccttcagtgcgggcccgctctcaagcctgtccgtcacctcccagaactcccacgttcccaaaaccctgtgttcccagtctctttggtctccagaactgtcattaaagaaagaaggggctaggcacagtggctcgtgcctgtcatcccagcactttgggaggccgaggtgggcggatcacctgaggtcagtttgagaccagcctgggcaacatggtgaaaccccatctttactaaaaatacaaaaattagctgggtgtggtggcgggtgcctgtaatcccagctactcaggaggctgaggcaggagaattgcttgaacccgggaggcagaggttgcagtgagccaagatcaagccattgcactctagccc

SEQ ID NO: 9787 - DNA, 4510 bp, Homo sapiens
tttttttttttttttttttttttttttgaaacagagtttcactgttgttgcccaggctggactgcaatggcacaatctctgctcaccgcaacctccgcctcccgggttcaagtgattctcgtgcctcagtctctcaagtagctgagattacaggcatgcaccaccacacccggctaattttgtatttttagtaaagacagggtttctccatgttggtcaggctggtctcaaactcccgacctcaggtgatccgcccgcctcggcctcccaaagggctgggatgacaggcgtgagccaccgcgcccagcccgagacagtgttgattgcttgagtcctagtctcaagcagtcctccccacctccgcctcccaaagcgctgggattataggcaaaagccacttaactcagccctgacgtgttgatagcgacaggaggcagccaaatgcataggcagatagggcgggtccccggtgaaaccacacctccaagccaaaaagcctgaagcctgaaaaacagaactgctggtctgggatgaaactcgagacccagagcgagaacttctgttcctgtttgcctgccctttcctgatgggttctttccgaataatgcttttagtttatattattattattattattattattattattattattattattattattattattttgagagagagagcctcactctgtcacccaggctggagtgcagtagcacgatcctggctgactgcaacctctacctcctggtgcaagcaattctcatgcctcagcctccccagtagctgggattacaggcgaacgtgaatgctaccacacccagctattttttgtattttagtagagataaggtttcaccatgttgcccaggctggtcccaaactcctgatctcagatgatgatctgcctgcctcagcctcccaaagtgttgggattacaggcatgagccacaacacccagcctgaataatgcttttaaccagttgaatgttgccttctctaatactacctatgacctgcccctccccaatactgagcccataaaagccctggactcagccacattgaggggactttcctgcctttaagtagggggaccacccccaaatcgcctctctgttgaaaactgttttatcactcaataaaccccccacctattgtatcactcaataaaatctccaccctcactcttcgattgccagtgtatccccattctttgtgggtgcaggacaagaacttgggaaccagtgcacaagccagactcggcccaggtggggtgagtgggcgagctgtctctgcagcaggtattgtggcccagcgaggcccaggtggggcatcatcggctggaggtccctggcttgcaaagtgactgagaataaaattgttcatcaattttaagtcactaactttgtggtaatttgttctggcagccctaggaaatgaggacagtgtgtcaaaggttcatttaactaattaatttacctgggtgtggtggctcaggcctgtaatgccaacactttgggaggcccaggcaggtcctgaggtcaggaattcaaaaccagcctggccaacatggcgaaaccccgtctctactaaaattacaaaattaactgggcatggtggcgcatgcttgtaattccagctacttgggaagctgaagcaaaagaatcacttgaacccgggaagcagaggttgcaaaaaaccgaaatctcgccactgcactccagcctgggcgacagagcaaaactctatctcaaaaaaaacaaaacaaaacaaaaaaaactgaccacagtggctcatgcctgtaattccagcactttgggaggctgaggcaggcagatcacctgaagttgggagttccagaccagcctaaccaacatggaaaaactctgtttttactaaaaatacaaaattagccaggcgtggtggcccatgcctgtaatcccagctactcgggaggctgaggcaggagaattgcttgagctcaggaggtggaggttgcagtgagccgagattgagccattgcactccagcctgggcaaaaaagtgagaccttgtctcaaaataaaataaaattaaattaaataaaaaataaatcacactgggccataaaatgaagctggtgtcagcaagtgtggtccaattatttacataggtgcagaaacagtgcaaatatcccatataggccaccttacgtttgctttgctggaagttttcataagaaatatcagattggggctgggtgccgtggctcacacctgtaatcccagcactttgggaggctgaggcaggtggatcacttgaggtcgggagttcgcaaccagcctgatcaacatggtgaaactctgtctctactaaaaatacaaaaattgccgggcgtggtggctcacgcctgtaatcccagcactttgggaggctgaggcgggcggatcacgaggtccagagatcgagaccatcttggctaacacggtgaaaccccgtctctactctatatacaaaaaaaaaaaaaaaaaaattaggtgggtatggtagcacgtgcctgtagtcccagctactcatggctgaggcaggagaatcacttgaacccggaaggtggaggttgcagtgagccaagattgcaccactgtgccagcctgagtgacagagtgagactcggtctcgaaaaaacaaaacaaaacaaaaattagctgggggtggtggcagacgcctgtaatttcagctactcgggaggctgaggcagaagaatcgcttgaacccaggaggcggaggttgcagtgatctgagatcacaccattggactccagcctgggtgacaaaagtgaaacagtctcaaagaaaagaaagaaatatcagagtggacctgtattgtttgcttctttgcagaggcaagaaacgcaatacctataatttgggtcaatttctatgttcctgggcctgccaggaaatcaccttcctggtcacctgcaaagcctggggtctgcaccctcaggaagatttgcaggcactccttcataacagcaacccaaggtccgcagcagcggctggtcatccccagtgaaagagcagaactctccatatgacaacctggacaaggccttggtgacctaaccaattcatccaattgtcttctgtaaaaggagaagagtctcttaactgaatctatgtgctgtggtttgaaagtgtcccccagagttcatggattgcaaacctgatccccagtgtggcagtaatggaggtgggacctttttatttttttctgagatggaatctcgctctgtcatcccaggctggagtgcaatggtgcgatcttggcttgtcgcaacctctgcctcccaggttcaaacaattctcccgcctcagcctcccgaatagctgggattacaggcatgtgccaccacgcctggcaaattttgtatatttagagagacggggtttctccatgttggtcaggctggtcttgaactcctgacctagtgatccgcccgcctccacctcccaaagtgctgggattacagtcgtgaaccaccacaccccgccagaggtgggacctttaagaggtgattaggtcttgagggcttcaccctcatgaagggattaatgccattatttcgggaattgattccttataaaaggatgagtttggcccctttccgtccagccacataatgcctgctggcatgttatgtggcagcaggaaggtcctcatgagatgtggcccctccctcttggacctccaaatctccagaaccaataaatcccagtttattatcaattacccagtctgtggcattatagcagcacaaaacgaactaagacactgtagggtccagccctatggggctaagcgggtgttgtccccatgtgcagagacgagagattgtagtaaataaagacacaagacaaagagataaagagaaaacagctgggcccgggggaccactaccatcaagacgcagagactggtagtggccccgaatggctgggcgcgctgatatttattgcatacaagacaagggggggcagggtaaggagggtgaatcttctaagtgattgacaaggtgaagcaagtcacatgatcataggacagggggcccttccttcttaggtagccgaagcagagagagaaggcagcaaacgtcagcgttttcttgtatgcacttacaagaaagatcaaagactttaagactttcactatttcttctactgctatttactacaaacttcaaagaggaactaggagtacaggaggagcatgaaagtggacaaggagcgtgaacattgaagcaccacagggaggggtttaggcctccggatgattgcggccaggcctggataatatccagccttccacaagaagctggtggagcagagtgttccctgactcctccaaggaaaggagactccctttcgcagtctattaagcaacgggtgacttcccagacactggcgttagggcttgaccaaggagccctcaagcagcccttatgcgggcgtgacagagggctca

SEQ ID NO: 9788 - DNA, 1181 bp, Homo sapiens
caggaagtcgattctgagacccgataccctgcgaggggagtgcaggataagcaggagacattaattagcgctgccttaagcagttttaccgacgcaggcgggactgtggtggagcactggagatgctgcgagccctgagctgccttcacagccttgttgggtgtgctgctggatcacactgcatgagaaatggaagcaacctatctgtaaagagcctgcaaacctcaggacgctctggaagccagtggaataattacagtgggatgaggctgcaagtccccttgcttcctgagctgcattcatggctgtgtgaaggggagaaaggaatacatttgaggtcttttcatggaagacacagatattttaatgttgcgataccatccaacagggtgagctgagagaaccaacactaagagtttcacagatagaacaccactattccctgtgtaaaacaggaggtaggcaggcgtaggcctcccctggaaaacaatgttttaagagctcataaatacctagacgtcaaatcatcctcgtttctagtgtttgtatagatatttccaataatatatttagtgggctcacttttttattttgtgcatttatcctggtttattgtttatttttcctgaattattggccaatgaatatttatattagaacagaaaaaaatatattctaaaattaatgtcataaaaataagttacatcagttagatgtcctctgcatgagaaagggataagatggattgctaaatatcccctggggctgagccagcaagactaggactgcacacccctcatcattagcaaggacacaaaatcacggaggagacccagttggccagggcagaccagccaggcagtgctgtgtcgaacgcatgatgaatgtggtggatgcattgagctctcttcccagctgaggagttaaagagaaacatttagtaaaaagggccaggatttagtcacaatgctaccctctcccgatagaataattaagcaatgaacacagctgcacatttctggaatggacactgcgagaaaggtgtagtttttccatgttgtatggcatttgttttcttgcaaacaggcaagcacgggctaggactgtttctacgcctgtctgcactgtgatatgcactgtcttcgctgcagaagagcaccacaatgctgccttcatattcc
